(12) United States Patent
Saville et al.

(10) Patent No.: US 10,889,842 B2
(45) Date of Patent: Jan. 12, 2021

(54) MICROORGANISMS FOR THE ENHANCED PRODUCTION OF AMINO ACIDS AND RELATED METHODS

(71) Applicant: CALYSTA, INC., Menlo Park, CA (US)

(72) Inventors: Renee M. Saville, Mountain View, CA (US); Joshua A. Silverman, Los Altos Hills, CA (US); Eric G. Luning, Sunnyvale, CA (US); Brandon D. Doss, Mountain View, CA (US); Lorraine Joan Giver, Sunnyvale, CA (US); Sol M. Resnick, Encinitas, CA (US); Drew D. Regitsky, San Francisco, CA (US)

(73) Assignee: CALYSTA, INC., Menlo Park, CA (US)

( * ) Notice: Subject to any disclaimer, the term of this patent is extended or adjusted under 35 U.S.C. 154(b) by 0 days.

(21) Appl. No.: 14/599,383

(22) Filed: Jan. 16, 2015

(65) Prior Publication Data

US 2015/0197779 A1 Jul. 16, 2015

Related U.S. Application Data

(60) Provisional application No. 61/928,401, filed on Jan. 16, 2014.

(51) Int. Cl.

| C12N 1/04 | (2006.01) |
|---|---|
| C12N 1/32 | (2006.01) |
| C12P 13/08 | (2006.01) |
| C12P 13/12 | (2006.01) |
| C12N 15/52 | (2006.01) |
| C12N 1/30 | (2006.01) |

(52) U.S. Cl.
CPC ............. *C12P 13/08* (2013.01); *C12N 1/30* (2013.01); *C12N 15/52* (2013.01); *C12P 13/12* (2013.01)

(58) Field of Classification Search
None
See application file for complete search history.

(56) References Cited

U.S. PATENT DOCUMENTS

| 4,824,786 A * | 4/1989 | Hanson | C12N 15/74 435/252.3 |
|---|---|---|---|
| 7,098,005 B2 | 8/2006 | Dicosimo et al. | |
| 7,192,747 B2 | 3/2007 | Ono et al. | |
| 7,217,543 B2 | 5/2007 | Gunji et al. | |
| 2003/0129708 A1 * | 7/2003 | Ptitsyn | C12N 9/93 435/91.1 |
| 2003/0166174 A1 * | 9/2003 | Ono | C12P 13/04 435/106 |
| 2004/0142437 A1 * | 7/2004 | Flint | C12N 9/1029 435/136 |
| 2005/0124033 A1 * | 6/2005 | Sharpe | C12N 9/00 435/67 |
| 2005/0255568 A1 * | 11/2005 | Bailey | C12N 9/0006 435/113 |
| 2006/0019355 A1 * | 1/2006 | Ueda | C07K 14/245 435/106 |
| 2006/0057726 A1 * | 3/2006 | Sharpe | C12N 9/00 435/471 |
| 2008/0026005 A1 | 1/2008 | Miguez et al. | |
| 2009/0191610 A1 | 7/2009 | Zelder et al. | |
| 2009/0281353 A1 * | 11/2009 | Zelder | C12P 13/12 562/559 |
| 2010/0151505 A1 * | 6/2010 | Pan | C12N 1/36 435/15 |
| 2010/0221813 A1 | 9/2010 | Miguez et al. | |
| 2011/0033452 A1 * | 2/2011 | Nakano | C07K 16/303 424/133.1 |
| 2011/0097767 A1 * | 4/2011 | Pharkya | C12N 15/52 435/128 |
| 2012/0282290 A1 * | 11/2012 | Spencer | C07K 14/435 424/190.1 |
| 2012/0288901 A1 * | 11/2012 | Zelder | C12N 9/0006 435/113 |
| 2012/0288902 A1 * | 11/2012 | Nonaka | C07K 14/245 435/113 |
| 2013/0171181 A1 * | 7/2013 | Ni | A61K 39/39 424/186.1 |
| 2014/0013658 A1 * | 1/2014 | Silverman | C10G 3/00 44/308 |
| 2014/0024782 A1 | 1/2014 | Kim et al. | |
| 2014/0273236 A1 * | 9/2014 | Reeves | C12N 15/63 435/471 |
| 2015/0232886 A1 | 8/2015 | Silverman et al. | |

(Continued)

FOREIGN PATENT DOCUMENTS

| EP | 0 296 484 A2 | 12/1988 |
|---|---|---|
| EP | 0 837 134 A2 | 4/1998 |

(Continued)

OTHER PUBLICATIONS

SEQ Align MatA (2016) pp. 1-2.*
Brambilla et al. (2010) Complete genome sequence of Methanoplanus petrolearius type strain (SEBR 4847), Stand Gnomonic Sci., vol. 3, No. 2, pp. 203-211.*
NCBI (2010) Anthranilate synthase [Methanolacinia petrolearia DSM 11571], www.ncbi.nlm.nih.gov/protein/ADN35688.1, pp. 1-2.*
Muller et al. (1995) "abstract" Microbial production of specifically ring-13C-labelled 4-hydroxybenzoic acid, Appl. Microbiol. Biotechnol., vol. 43, No. 6, pp. 985-988.*

(Continued)

*Primary Examiner* — Manjunath N Rao
*Assistant Examiner* — Samuel W Liu
(74) *Attorney, Agent, or Firm* — Seed IP Law Group LLP

(57) ABSTRACT

The present disclosure relates to recombinant microorganisms engineered for enhance production of a desired amino acid, as well as related biomass, and compositions which are useful, inter alia, as animal feed ingredients. The present invention also provides related methods.

21 Claims, 4 Drawing Sheets
Specification includes a Sequence Listing.

(56) References Cited

U.S. PATENT DOCUMENTS

| | | |
|---|---|---|
| 2015/0232888 A1 | 8/2015 | Silverman et al. |
| 2015/0275219 A1 | 10/2015 | Silverman et al. |
| 2015/0299745 A1 | 10/2015 | Silverman |
| 2016/0017374 A1 | 1/2016 | Leonard et al. |

FOREIGN PATENT DOCUMENTS

| | | |
|---|---|---|
| WO | WO 98/42831 A2 | 10/1998 |
| WO | 02/18617 A2 | 3/2002 |
| WO | 2014/089436 A1 | 6/2014 |
| WO | 2015/109265 A1 | 7/2015 |

OTHER PUBLICATIONS

NCBI (2012) Mob [*Escherichia coli*], /www.ncbi.nlm.nih.gov/protein/EIN15572.1, p. 1.*

NCBI reference (2000) anthranilate synthetase component II, partial [*Pseudomonas aeruginosa*], pp. 1-2.*

Ali et al., "Duplication of the mmoX gene in *Methylosinus sporium*: cloning, sequencing and mutational analysis," *Microbiology 152*:2931-2942, 2006.

Brosius, "Toxicity of an overproduced foreign gene product in *Escherichia coli* and its use in plasmid vectors for the selection of transcription terminators," *Gene 27*: 161-172, 1984.

Eroshin et al., "Influence of Amino Acids, Carboxylic Acids and Sugars on the Growth of *Methylococcus capsulatus* on Methane," *J. appl. Bact. 31*:560-567, 1968.

Föner et al., "Expression of polyhydroxyalkanoic-acid-biosynthesis genes in methylotrophic bacteria relying on the ribose monophosphate pathway," *Appl Microbiol Biothechnol 40*:284-291, 1993.

Hanson et al., "Methanotrophic Bacteria," *Microbiological Reviews 60*(2):439-471, 1996.

Ishida et al., "Metabolic Engineering of *Saccharomyces cerevisiae* for Efficient Production of Pure $_L$-(+)-Lactic Acid," *Applied Biochemistry and Biotechnology 129-132*:795-807, 2006.

Kim et al., "Creating auxotrophic mutants in *Mehtylophilus methylotrophus* AS1 by combining electroporation and chemical mutagenesis," *Appl Microbiol Biotechnol 48*:105-108, 1997.

Lloyd et al., "Heterologous expression of soluble methane monooxygenase genes in methanotrophs containing only particulate methane monooxygenase," *Arch Microbiol 171*:364-370, 1999.

Martin et al., "Methane monooxygenase mutants of *Methylosinus trichosporium* constructed by marker-exchange mutagenesis," *FEMS Microbiology Letters 127*:243-248, 1995.

Motoyama et al., "Effects of the amplification of the genes coding for the L-threonine biosynthetic enzymes on the L-threonine production from methanol by a gram-negative obligate methylotroph, *Methylobacillus glycogenes,*" *Appl Microbiol Biotechnol 42*:67-72, 1994.

Springer et al., "Sequence and characterization of mxaB, a response regulator involved in regulation of methanol oxidation, and of mxaW, a methanol-regulated gene in *Methylobacterium extorquens* AM1," *FEMS Microbiology Letters 160*:119-124, 1998.

Stolyar et al., "Role of multiple gene copies in particulate methane monooxygenase activity in the methane-oxidizing bacterium *Methylococcus capsulatus* Bath," *Microbiology 145*:1235-1244, 1999.

Stolyar et al., "Search for Systems of Genetic Exchange in Methane-Oxidizing Bacteria," *Mikrobiologiya 64*(5):686-691, 1995.

Templeton et al., "Variable carbon isotope fractionation expressed by aerobic $CH_4$-oxidizing bacteria," *Geochimica et Cosmochimica Acta 70*:1739-1752, 2006.

Toyama et al., "Construction of insertion and deletion mxa mutants of *Methylobacterium extorquens* AM1 by electroporation," *FEMS Microbiology Letters 166*:1-7, 1998.

Toyama et al., "pqqA is not required for biosynthesis of pyrroloquinoline quinone in *Methylobacterium extorquens* AM1," *Microbiology 144*:183-191, 1998.

Toyoma, "Sequence analysis of pqq genes required for biosynthesis of pyrroloquinoline quinone in *Methylobacterium extorquens* AM1 and the purification of a biosynthetic intermediate," *Microbiology 143*:595-602, 1997.

Van Dien et al., "Reconstruction of $C_3$ and $C_4$ metabolism in *Methylobacterium exterquens* AM1 using transposen mutagenesis," *Microbiology 149*:601-609, 2003.

Whiticar et al., "Methane oxidation in sediment and water column environments—Isotope evidence," *Advances in Organic Geochemistry 10*:759-768, 1985.

Whiticar, "A geochemical perspective of natural gas and atmospheric methane," *Advances in Organic Geochemistry 16*(1-3):531-547, 1990.

Yoshida et al., "Improved conditions for the transformation by electroporation of the extracellular polysaccharide-producing methylotroph *Methylobacillus* sp.," *Biotechnology Letters 23*:787-791, 2001.

Heggeset et al., "Genome Sequence of Thermotolerant *Bacillus methanolicus*: Features and Regulation Related to Methylotrophy and Production of L-Lysine and L-Glutamate from Methanol," *Applied and Environmental Microbiology 78*(15):5170-5181, 2012. (12 pages).

Mordukhova et al., "Stabilized homoserine o-succinyltransferases (MetA) or L-methionine partially recovers the growth defect in *Escherichia coli* lacking ATP-dependent proteases or the DnaK chaperone," *BMC Microbiology 13*:179, 2013. (14 pages).

Müller et al., "Engineering *Escherichia coli* for methanol conversion," *Metabolic Engineering 28*:190-201, 2015. (12 pages).

Müller et al., "Methylotrophy in the thermophilic *Bacillus methanolicus*, basic insights and application for commodity production from methanol," *Applied Microbiology and Biotechnology 99*(2):535-551, 2015. (18 pages).

Nærdal et al., "Analysis and Manipulation of Aspartate Pathway Genes for L-Lysine Overproduction from Methanol by *Bacillus methanolicus*," *Applied and Environmental Microbiology 77*(17):6020-6026, 2011. (8 pages).

* cited by examiner

MICROORGANISMS FOR THE ENHANCED PRODUCTION OF AMINO ACIDS AND RELATED METHODS

CROSS-REFERENCE TO RELATED APPLICATIONS

This application claims the benefit of provisional application U.S. Ser. No. 61/928,401, filed Jan. 16, 2014, pursuant 35 U.S.C. § 119(e), which is incorporated herein by reference in its entirety.

REFERENCE TO SEQUENCE LISTING

The "Sequence Listing" submitted electronically concurrently herewith pursuant 37 C.F.R. § 1.821 in computer readable form (CRF) via EFS-Web as file name 200206_415_SEQUENCE_LISTING.txt is incorporated herein by reference. The electronic copy of the Sequence Listing was created on Jan. 16, 2015, and the size on disk is 851 kilobytes.

FIELD OF THE INVENTION

The present disclosure relates to novel microorganisms for the enhanced production of amino acids and feed products derived from recombinant $C_1$ metabolizing microorganisms comprising an engineered metabolic pathway for the enhanced production of amino acids and related compositions and methods.

BACKGROUND

Advances in the efficiency in animal feed utilization have been achieved over the past several decades through the use of feed additives. These added substances augment the nutrient-content, energy-content, and/or disease fighting properties of animal feed compositions. A growing challenge for commercial animal producers is the rising cost of grain. The rising costs are due in part to competing demands for grains for biofuel and human food use. With the rising cost of grain and protein components, coupled with limited land available for feed production, alternative low cost animal feed products with beneficial nutritive and disease fighting properties would be highly desirable.

SUMMARY

In a first embodiment, the present invention provides a recombinant $C_1$ metabolizing microorganism comprising a first exogenous nucleic acid selected from the group consisting of an exogenous nucleic acid that encodes an L-amino acid biosynthesis enzyme and an exogenous nucleic acid that encodes an expression control sequence that is operably linked to a nucleic acid that encodes a native L-amino acid biosynthesis enzyme, wherein the recombinant $C_1$ metabolizing microorganism is capable of converting a natural gas-derived carbon feedstock into a desired L-amino acid, and wherein the $\delta^{13}C$ of the recombinant $C_1$ metabolizing microorganism is less than −30‰.

In another embodiment, the recombinant $C_1$ metabolizing microorganism of the present invention further comprises a second exogenous nucleic acid that encodes a cache polypeptide. In further embodiments, the present invention provides a biomass derived from a culture of the recombinant $C_1$ metabolizing microorganism of the present invention, and a composition comprising the biomass of the present invention. In another embodiment, the present invention provides an amino acid composition comprising one or more amino acids extracted from the biomass of the present invention.

In a still further embodiment, the present invention provides an animal feed comprising the biomass or amino acid composition of the present invention. In some embodiments, the animal feed further comprises an additive selected from the group consisting of a plant-derived material, an animal derived material, and a microorganism-derived material.

In still further embodiments, the present invention provides a method of producing a desired L-amino acid, the method comprising culturing the recombinant $C_1$ metabolizing microorganism of the present invention in the presence of a natural gas-derived carbon feedstock under conditions sufficient to produce the desired L-amino acid. In some embodiments, the L-amino acid exhibits a $\delta^{13}C$ of less than −30‰.

In an additional embodiment, the present invention provides a method of producing an L-amino acid enriched biomass, the method comprising culturing the recombinant $C_1$ metabolizing microorganism of the present invention in a culture medium in the presence of a natural gas-derived carbon feedstock under conditions sufficient to promote growth of the recombinant $C_1$ metabolizing microorganism into a biomass.

DETAILED DESCRIPTION

Figure 1:
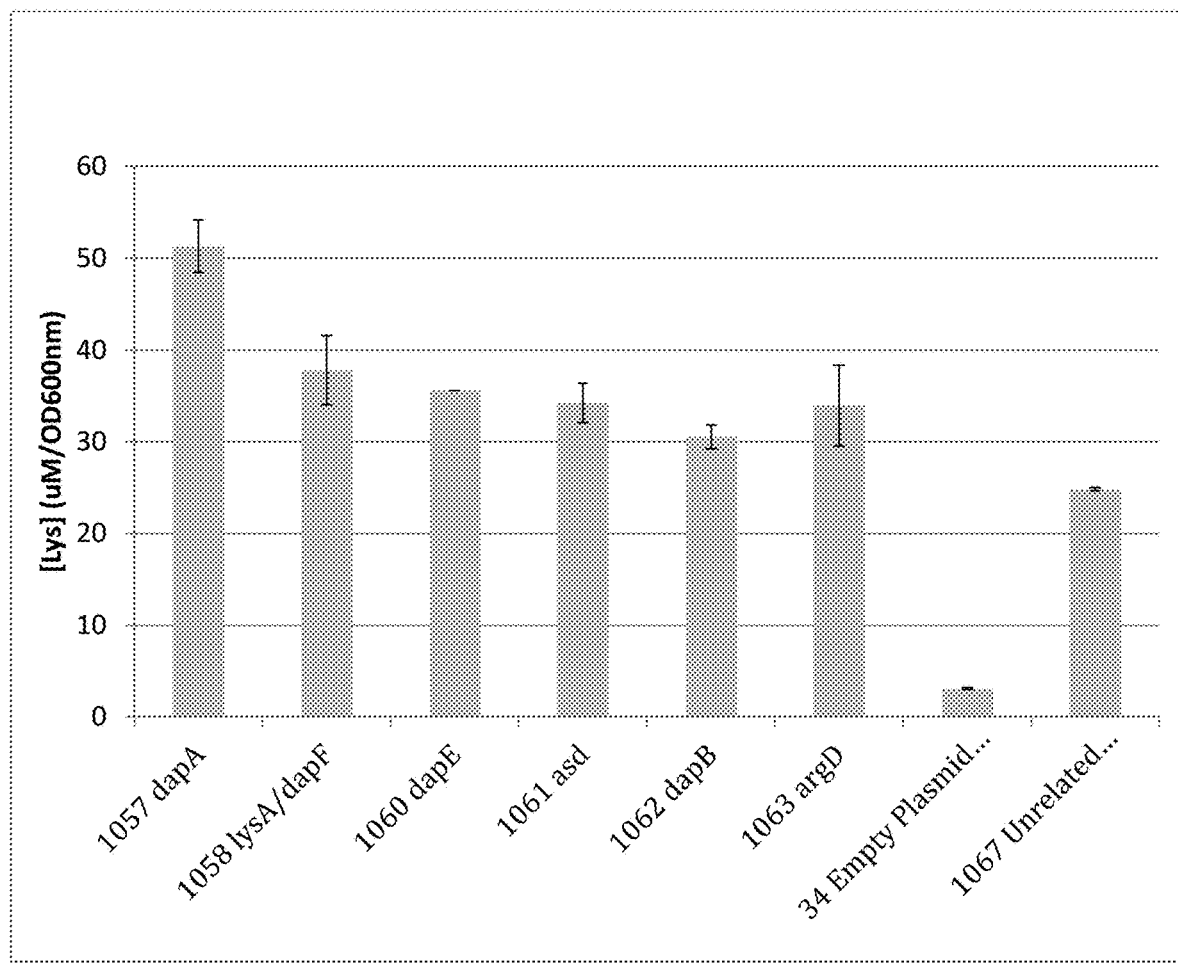
FIG. 1 provides a graphical depiction of the level of extracellular L-lysine production in *Methylococcus capsulatus* Bath strains that overexpress individual genes from the lysine biosynthesis operon as described in Example 4. Concentration of extracellular L-lysine detected in cell supernatant of strains heterologously expressing the indicated gene, divided by the optical density ($OD_{600\ nm}$) of the culture is shown for each strain. Genotype keys 34 and 1067 are empty plasmid control and a control expressing an unrelated gene (a fluorescent protein) in the same promoter context, respectively. The graph shows that overexpression of the indicated genes results in an increase in extracellular L-lysine over empty plasmid control (genotype key 34) and a control that expresses an unrelated gene (green fluorescent protein).

The instant disclosure provides novel recombinant $C_1$ metabolizing microorganisms that have the ability to utilize relatively low cost carbon feedstocks as an energy source, and in addition, provides desirable related biomass, nutrient products, compositions. The recombinant microorganisms of the present invention are engineered for the enhanced production of L-amino acids which are commercially desirable. These recombinant microorganisms, as well as the biomass and L-amino acid compositions that are derived from them, are useful as a source of nutrition for animals (such as, for example, livestock, fish, poultry, and the like), as well as cultured or fermented microorganisms.

In one embodiment, the present disclosure provides a recombinant $C_1$ metabolizing microorganism, wherein the recombinant $C_1$ metabolizing microorganism comprises an exogenous nucleic acid selected from the group consisting of an exogenous nucleic acid that encodes an L-amino acid biosynthesis enzyme and an exogenous nucleic acid that encodes an expression control sequence that is operably linked to a nucleic acid encoding a native L-amino acid biosynthesis enzyme, wherein the recombinant $C_1$ metabolizing microorganism is capable of converting a natural gas carbon feedstock into a desired L-amino acid, and wherein the recombinant $C_1$ metabolizing microorganism exhibits a $\delta^{13}C$ of less than –30‰, and often less than –35‰. Typically, a recombinant $C_1$ metabolizing microorganism is a non-photosynthetic $C_1$ metabolizing microorganism, and more typically, it is a methanotrophic microorganism.

In these embodiments, the recombinant microorganisms of the present invention are engineered to convert natural gas-derived feedstock, which is a relatively low cost and abundant resource (for example, natural gas, or a $C_1$ substrate derived from natural gas, such as, for example, methane) as compared to more costly carbohydrates, to higher valued nutrients. As used herein, the term "natural gas-derived feedstock" refers to natural gas, or any of the components isolated from natural gas (including $C_1$ substrates) or converted from natural gas (e.g., syngas).

The term "natural gas" refers herein to naturally occurring gas mixtures that may be obtained by conventional processes (e.g., drilling and water flooding of porous reservoirs) or non-conventional processes (e.g., hydraulic fracturing, horizontal drilling or directional drilling of formations having low gas permeability). The gas mixtures are made up of methane and other compounds, including other $C_1$ compounds, as well as other light alkane gases (such as, for example, ethane, propane, butane, pentane, and the like), carbon dioxide, nitrogen, hydrogen sulfide, or the like, and combinations thereof. Unconventional natural gas may be obtained from sources such as, for example, tight gas sands formed in sandstone or carbonate, coal bed methane formed in coal deposits and adsorbed in coal particles, shale gas formed in fine-grained shale rock and adsorbed in clay particles or held within small pores or microfractures, methane hydrates that are a crystalline combination of natural gas and water formed at low temperature and high pressure in places such as under oceans and permafrost.

As used herein, "$C_1$ substrate" or "$C_1$ compound" refers to any carbon containing molecule or composition that lacks a carbon-carbon bond. Exemplary $C_1$ substrates include syngas, methane, methanol, formaldehyde, formic acid or a salt thereof, carbon monoxide, carbon dioxide, methylated amines (e.g., methylamine, dimethylamine, trimethylamine, etc.), methylated thiols, methyl halogens (e.g., bromomethane, chloromethane, iodomethane, dichloromethane, etc.), cyanide, or any combination thereof.

In certain embodiments of the present invention, the natural gas-derived feedstock is often natural gas, a $C_1$ substrate from natural gas, or is syngas. Typically the $C_1$ substrate is methane. Invention recombinant $C_1$ metabolizing microorganisms which have utilized a natural gas-derived carbon substrate as a feedstock exhibit a distinctive isotopic carbon signature which is described in more detail hereinbelow. This distinctive isotopic carbon signature is also exhibited by the products of such recombinant microorganisms (e.g., biomass, L-amino acid, L-amino acid compositions, and the like).

As used herein, the terms "$C_1$ metabolizing microorganism" or "$C_1$ metabolizing non-photosynthetic microorganism" refer to any microorganism having the ability to use a $C_1$ substrate as a source of energy or as its primary source of energy and biomass, and may or may not use other carbon substrates (such as sugars and complex carbohydrates) for energy and biomass. For example, a $C_1$ metabolizing microorganism may oxidize a $C_1$ substrate, such as methane or methanol. $C_1$ metabolizing microorganisms include bacteria (such as methanotrophs and methylotrophs) and yeast. In certain embodiments, a $C_1$ metabolizing microorganism does not include a photosynthetic microorganism, such as algae. In some embodiments, the $C_1$ metabolizing microorganism will be an "obligate $C_1$ metabolizing microorganism," meaning its sole source of energy are $C_1$ substrates. In further embodiments, a $C_1$ metabolizing microorganism (e.g., methanotroph) will be cultured in the presence of a $C_1$ substrate feedstock (i.e., using the $C_1$ substrate as a source of energy).

Recombinant $C_1$ metabolizing microorganisms of the present invention are engineered for enhanced production of a desired L-amino acid via engineering of an L-amino acid biosynthesis (AB) enzyme encoding nucleic acid or expression thereof. The terms "L-amino acid biosynthesis enzyme" and "AB enzyme" are used interchangeably herein to refer to an enzyme that is involved in the production of an L-amino acid by the recombinant host $C_1$ metabolizing microorganism.

In a one embodiment, the present invention provides a recombinant $C_1$ metabolizing microorganism comprising a first exogenous nucleic acid selected from the group consisting of an exogenous nucleic acid that encodes an L-amino acid biosynthesis enzyme and an exogenous nucleic acid that encodes an expression control sequence that is operably linked to a nucleic acid that encodes a native L-amino acid biosynthesis enzyme. Typically, the $\delta^{13}C$ of a recombinant $C_1$ metabolizing microorganism is less than –30‰, as described in more detail herein. Usually, the recombinant $C_1$ metabolizing microorganism is a methanotrophic microorganism.

In some embodiments, the recombinant $C_1$ metabolizing microorganism of the present invention further comprises a second exogenous nucleic acid that encodes a cache polypeptide. As used herein, the term "cache polypeptide" refers to a polypeptide that has an amino acid sequence which: (1) is at least about 10 amino acid residues in length; and (2) comprises the L-amino acid targeted for enhancement at a level that is at least 10% (by species) of the total number of amino acid residues in the amino acid sequence. Typically, a cache polypeptide is not an AB (amino acid biosynthesis) enzyme.

Cache polypeptides are useful for facilitating the enhanced production of desired L-amino acids in the recombinant $C_1$ metabolizing microorganisms of the present invention as demonstrated in the examples. In some embodiments, the amino acid sequence of the cache polypeptide may (1) be at least about 10 amino residues in length, at least about 15, at least about 20, at least about 30, at least about 40, at least about 50, at least about 60, at least about 70, at least about 80, at least about 90, at least about 100, at least about 150, at least about 200, at least about 250, at least about 300, at least about 350, at least about 400, at least about 450, or at least about 500 amino acid residues in length; and (2) comprise the L-amino acid targeted for enhancement at a level that is at least about 10% (by species) of the total number of amino acid residues in the amino acid sequence, or a level that is at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, or at least about 95% of the total number of amino acid residues in the amino acid sequence. The cache polypeptide employed in the practice of the present invention may be a naturally occurring polypeptide or a non-naturally occurring polypeptide. The second exogenous nucleic acid that encodes the cache polypeptide is typically codon optimized for optimal expression from the recombinant host $C_1$ metabolizing microorganism. An exemplary cache polypeptide is the S9A family peptidase (SEQ ID NO: 152) as illustrated Examples 5 and 6. Nucleic acid sequences that encode the S9A family peptidase which have been codon optimized for optimal expression from *Methylococcus capsulatus* Bath are provided as SEQ ID NOs: 152, 154, 156, 158, 160, 162, 164, and 166. As used herein, the terms "polypeptide" and "protein" are used interchangeably to refer to a polymer of amino acid residues.

One of ordinary skill in the art can readily identify cache polypeptides suitable for use in the present invention by searching for proteins in which at least 10% of the total amino acid content is the desired L-amino acid. This can be done, for example, by querying a sequence database, such as, for example, GENBANK (the world wide web at ncbi.nlm.nih.gov/genbank/) for all proteins from the organism of interest, and then computing the ratio of [occurrences of desired amino acid]/[protein sequence length] for each protein. The result of this analysis can be filtered and sorted based on the ratio to find suitable proteins.

Exogenous nucleic acids encoding AB enzymes and cache polypeptides that are employed in the practice of the present invention are typically codon optimized for optimal expression from the recombinant host $C_1$ metabolizing microorganism. These may encode an enzyme or protein that is either native to a species heterologous to the host $C_1$ microorganism or encode a mutant (i.e., variant) of a polypeptide that exists in nature. When the first exogenous nucleic acid encodes an AB enzyme, the exogenous nucleic acid may be a nucleic acid that encodes an AB enzymes involved in the biosynthesis of an L-amino acid selected from the group consisting of L-lysine, L-tryptophan, L-methionine, L-cysteine, L-threonine, L-histidine, L-isoleucine, L-leucine, L-phenylalanine, L-valine, L-alanine, L-arginine, L-asparagine, L-aspartic acid, L-glutamic acid, L-glutamine, L-glycine, L-ornithine, L-proline, L-serine, and L-tyrosine. In some embodiments, the L-amino acid is selected from the group consisting of L-lysine, L-tryptophan, L-methionine, L-cysteine, L-threonine, and the like. In some instances, the L-amino acid is selected from the group consisting of L-lysine, L-tryptophan, L-methionine, L-cysteine, and L-threonine. Suitable exogenous nucleic acids include those which encode an L-amino acid biosynthesis enzyme selected from the group consisting of:

(i) an L-lysine biosynthesis enzyme, such as, for example: a lysine-sensitive aspartokinase III (lysC), an aspartate kinase, an aspartate-semialdehyde dehydrogenase (asd), a dihydrodipicolinate synthase (dapA), a dihydrodipicolinate reductase (dapB), a 2,3,4,5-tetrahydropyridine-2,6-carboxylate N-succinyltransferase (dapD), an acetylornithine/succinyldiaminopimelateaminotransferase (argD), a succinyl-diaminopimelate desuccinylase (dapE), a succinyldiaminopimelate transaminase, a diaminopimelate epimerase (dapF), a diaminopimelate dicarboxylase (lysA), and the like; (ii) an L-tryptophan biosynthesis enzyme, such as, for example, a chorismate-pyruvate lyase (ubiC), an anthranilate synthase component I (trpE), an anthranilate synthase component II (trpG), an anthranilate phosphoribosyltransferase (trpD), a phosphoribosylanthranilate isomerase (trpC), a tryptophan biosynthesis protein (trpC), an N-(5'phosphoribosyl) anthranilate isomerase (trpF), an indole-3-glycerol phosphate synthase, a tryptophan synthase alpha chain (trpA), a tryptophan synthase beta chain (trpB), and the like;

(iii) an L-methionine biosynthesis enzyme, such as, for example, a homoserine O-succinyltransferase (metA), a cystathionine gamma-synthase (metB), a protein MalY, a cystathionine beta-lyase (metC), a B12-dependent methionine synthase (metH), a 5-methyltetrahydropteroyltriglutamate-homocysteine S-methyltransferase (metE), and the like;

(iv) an L-cysteine biosynthesis enzyme, and wherein the cysteine biosynthesis enzyme is selected from the group consisting of a serine acetyltransferase (CysE) a cysteine synthase A, a cysteine synthase B, and the like; and (v) an L-threonine biosynthesis enzyme, such as, for example an aspartate transaminase, a PLP-dependent aminotransferase, an aspartate aminotransferase, an aspartate kinase, an aspartate-semialdehyde dehydrogenase, a homoserine dehydrogenase, a homoserine kinase, a threonine synthase, and the like.

The above enzymes can be found in a number of heterologous species, including microorganisms, such as, for example, *E. coli* and *Corynebacterium glutamicum*. In certain specific embodiments, the exogenous nucleic acid encodes an L-amino acid biosynthesis enzyme having the sequence of any one of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, or 150 shown in Table A, hereinbelow. As described above, the exogenous nucleic acid is typically codon optimized for optimal expression from the recombinant $C_1$ metabolizing microorganism. Exemplary nucleic acid sequences encoding these AB enzymes are also provided in Table A. These nucleic acid sequences have been codon optimized for expression in *Methylococcus capsulatus* Bath.

TABLE A

Exemplary Amino Acid Biosynthesis Enzymes

| Source/Name | Amino Acid Sequence SEQ ID NO. | Nucleic Acid Sequence SEQ ID NO. |
|---|---|---|
| *E. coli* K12: Lysine sensitive aspartokinase 3 (lysC) | 2 | 1 |
| *Corynebacterium glutamicum*: Aspartokinase (lysC) | 4 | 3 |
| *E. coli* K-12: Aspartate semialdehyde dehydrogenase (asd) | 6 | 5 |
| *E. coli* F11: dihydrodipicolinate synthase (dapA) | 8 | 7 |
| *E. coli* K-12: dihydrodipicolinate reductase (dapB) | 10 | 9 |
| *Corynebacterium glutamicum*: dihydrodipicolinate reductase (dapB) | 12 | 11 |
| *E. coli*: bifunctional acetylornithine aminotransferase/succinyldiaminopimelate aminotransferase | 14 | 13 |
| *Corynebacterium glutamicum*: acetylornithine aminotransferase | 16 | 15 |
| *E. coli*: succinyl-diaminopimelate desuccinylase (dapE) | 18 | 17 |
| *Corynebacterium glutamicum*: succinyl-diaminopimelate desuccinylase (dapE) | 20 | 19 |
| *Corynebacterium glutamicum*: (dapF) | 22 | 21 |
| *E. coli*: diaminopimelate decarboxylase | 24 | 23 |
| *Corynebacterium glutamicum*: diaminopimelate decarboxylase | 26 | 25 |
| *E. coli*: chorismate pyruvate lyase (ubiC) | 28 | 27 |
| *E. coli*: | anthranilate synthase component I (trpE) | 30 | 29 |
| *Corynebacterium glutamicum*: anthranilate synthase component (trpE) | 32 | 31 |
| *E. coli*: anthranilate synthase component II (trpG) | 34 | 33 |
| *Corynebacterium glutamicum*: anthranilate synthase component II (trpG) | 36 | 35 |
| *E. coli*: anthranilate phosphoribosyltransferase (trpD) | 38 | 37 |
| *Corynebacterium glutamicum*: anthranilate phosphoribosyltransferase (trpD) | 40 | 39 |
| *E. coli*: (trpC) | 42 | 41 |
| *Corynebacterium glutamicum*: bifunctional indole-3-Gcerol phosphate synthase/ phosphoribosylanthranilate isomerase(trpC) | 44 | 43 |
| *E. coli*: tryptophan biosynthesis protein (trpCF) | 46 | 45 |
| *Corynebacterium glutamicum*:: Tryptophan biosynthesis protein TrpCF; (TrpCF) | 48 | 47 |
| *E. coli*: fused indole-3-Gcerolphosphate synthetase/N-(5-phosphoribosyl)anthranilate isomerase (trpF) | 50 | 49 |
| *Corynebacterium glutamicum*: bifunctional indole-3-Gcerol phosphate synthase/ phosphoribosylanthranilate isomerase (trpF) | 52 | 51 |
| *E. coli*: tryptophan synthase alpha subunit (trpA) | 54 | 53 |
| *Corynebacterium glutamicum*: tryptophan synthase subunit alpha (trpA) | 56 | 55 |
| *E. coli*: tryptophan synthase beta subunit (trpB) | 58 | 57 |
| *Corynebacterium glutamicum*: tryptophan synthase subunit beta (trpB) | 60 | 59 |
| *E. coli* strain K12: Lysine-sensitive aspartokinase 3 | 62 | 61 |
| *Corynebacterium glutamicum*: Aspartokinase | 64 | 63 |
| *E. coli* K-12: aspartate semialdehyde dehydrogenase | 66 | 65 |
| *E. coli* F11: dihydrodipic olinate synthase (dapA) | 68 | 67 |
| *E. coli* K-12: dihydropdipicolinate reductase (dapB) | 70 | 69 |
| *Corynebacterium glutamicum*: dihydrodipicolinate reductase (dapB) | 72 | 71 |
| *E. coli* K12: bifunctional acetylornithine aminotransferase/succinyldiaminopimelate aminotransferase (argD) | 74 | 73 |
| *Corynebacterium glutamicum* (ATCC 13032): acetylornithine aminotrasnferase (argD) | 76 | 75 |
| *E. coli* F11: succinyl-diaminopimelate desuccinylase (dapE) | 78 | 77 |
| *Corynebacterium glutamicum*: succinyldiaminopimelate desuccinylase (dapE) (Acc. No. CAA57141.1) | 80 | 79 |
| *Corynebacterium glutamicum* (ATCC 13032): diaminopimelate epimerase (dapF) | 82 | 81 |
| *E. coli* K-12: diaminopimelate (lysA) (Acc. No. AAB40485.1 | 84 | 83 |

TABLE A-continued

Exemplary Amino Acid Biosynthesis Enzymes

| Source/Name | Amino Acid Sequence SEQ ID NO. | Nucleic Acid Sequence SEQ ID NO. |
|---|---|---|
| *Corynebacterium glutamicum* (ATCC 13032): diaminopimelate decarboxylase (lysA) | 86 | 85 |
| *E. coli* K-12: chorismatae pyruvate lyase (Acc. No. YP_492182.1) | 88 | 87 |
| *E. coli*: anthranilate synthase component I (Acc. No. AAA57297.1) | 90 | 89 |
| *Corynebacterium glutamicum*: anthranilate synthase component 1 (trpE) (Acc. No. CAA39467) | 92 | 91 |
| *E. coli*: anthranilate synthase (trpC): anthranilate synthase component II | 94 | 93 |
| *E. col* W: anthranilate phosphoribosyl transferase (Acc. No. ADT74841.1 | 96 | 95 |
| *E. coli* W: anthranilate phosphoribosyl transferase (trpD | 98 | 97 |
| *Corynebacterium glutamicum* (ATCC 13032): anthranilate phosphoribosyl transferase | 100 | 99 |
| *E. coli*: anthranilate isomerase (trpC) | 102 | 101 |
| *Corynebacterium glutamicum* (ATCC 13032): indole-3-glycerol phosphate synthase/phosphoribosylanthranilate isomerase (trpC) | 104 | 103 |
| *C. glutamicum*: ribosylanthranilate isomerase | 106 | 105 |
| *E. coli* K-12: fused indole-3-glycerolphosphate synthetase/N-(5-phosphoribosyl)anthranilate isomerase | 108 | 107 |
| *E. coli*: trpF (Acc. No. AAC74344.3) | 110 | 109 |
| *Corynebacterium glutamicum* (ATCC 13032): bifunctional indole-3-glycerol phosphate synthase/phosphoribosylanthranilate isomerase (trpF) | 112 | 111 |
| *E. coli*: tryptophan synthase alpha subunit (trpA) | 114 | 113 |
| *Corynebacterium glutamicum* (ATCC 13032): tryptophan synthase subunit alpha (trpA) | 116 | 115 |
| *E. coli*: trypophan synthase beta subunit (trpB) (Acc. No. AAA57300.1 | 118 | 117 |
| *Corynebacterium glutamicum* (ATCC 13032): tryptophan synthase subunit beta | 120 | 119 |
| *Methylococcus capsulatus* Bath dihydrodipicolinate synthase (dapA) | 122 | 121 |
| *Methylococcus capsulatus* Bath diaminopimelate decarboxylase (lysA) | 124 | 123 |
| *Methylococcus capsulatus* Bath diaminopimelate epimerase (dapF) | 126 | 125 |
| *Methylococcus capsulatus* Bath succinyldiaminopimelate desuccinylase (dapE) | 128 | 127 |
| *Methylococcus capsulatus* Bath aspartate-semialdehyde dehydrogenase (asd) | 130 | 129 |
| *Methylococcus capsulatus* Bath dihydrodipicolinate reductase (dapB) | 132 | 131 |
| *Methylococcus capsulatus* Bath acetylornithine aminotransferase (argD) | 134 | 133 |
| *E. coli* aspartate kinase I (thrA) | 136 | 135 |
| *E. coli* aspartate kinase II (metL) | 138 | 137 |
| *Methylococcus capsulatus* Bath aspartate kinase III | 140 | 139 |
| *Methylococcus capsulatus* Bath homoserine dehydrogenase | 142 | 141 |
| *Methylococcus capsulatus* Bath homoserine O-succinyltransferase (metA) | 144 | 143 |
| *Methylococcus capsulatus* Bath O-succinyl-L-homoserine sulfyhdrylase (metZ) | 146 | 145 |
| *Methylococcus capsulatus* Bath homocysteine transmethylase (metE) | 148 | 147 |
| *Methylococcus capsulatus* Bath methionine synthase (metH) | 150 | 149 |

Suitable exogenous nucleic acids employed in the practice of the present invention include those which encode a variant AB enzyme sequence that is at least 90%, at least 91%, at least 92%, at least 93%, at least 94%, at least 95%, at least 96%, at least 97%, at least 98%, or at least 99% identical to a reference or parental wildtype polypeptide sequence, such as, for example a reference sequence corresponding to any one of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, or 150, provided that the variant retains the L-amino acid biosynthesis enzyme activity of interest. In certain embodiments, the AB enzyme variant polypeptides will include at least one amino acid substitution (e.g., 1, 2, 3, 5, 6, 7, 8, 9 or 10 or more or up to 20, 25, or 30 substitutions) at a pre-determined position relative to a reference or parental wildtype AB enzyme, provided that a variant retains the AB enzyme activity of interest. The AB enzyme variant polypeptide may further comprise one or more conservative substitutions. A "conservative substitution" is recognized in the art as a substitution of one amino acid for another amino acid that has similar properties. Exemplary conservative substitutions are well known in the art (see, e.g., WO 97/09433, p. 10; Lehninger, Biochemistry, 2$^{nd}$ Edition; Worth Publishers, Inc. NY: NY (1975), pp. 71-77; Lewin, Genes IV, Oxford University Press, NY and Cell Press, Cambridge, Mass. (1990), p. 8, which are incorporated herein by reference).

Methods for generating suitable exogenous nucleic acids encoding such variant enzymes are described in more detail herein.

The "percent identity" between two or more nucleic acid or amino acid sequences is a function of the number of identical positions shared by the sequences (i.e., % identity=number of identical positions/total number of positions×100), taking into account the number of gaps, and the length of each gap that needs to be introduced to optimize alignment of two or more sequences. The comparison of sequences and determination of percent identity between two or more sequences can be accomplished using a mathematical algorithm, such as BLAST and Gapped BLAST programs at their default parameters (e.g., Altschul et al., *J. Mol. Biol.* 215:403, 1990; see also BLASTN at the world wide web at ncbi.nlm.nih.gov/BLAST, which are incorporated herein by reference).

As indicated above, the exogenous nucleic acids employed in the practice of the present invention may be codon optimized for expression in the $C_1$ metabolizing microorganism. Expression of recombinant proteins may be difficult outside their original host. For example, variation in codon usage bias has been observed across different species of bacteria (Sharp et al., *Nucl. Acids. Res.* 33:1141, 2005, which is incorporated herein by reference). Overexpression of recombinant proteins even within their native host may also be difficult. In certain embodiments, the nucleic acid to be introduced into a host as described herein may be subjected to codon optimization prior to introduction into the host to ensure protein expression is effective or enhanced. Codon optimization refers to alteration of codons in genes or coding regions of nucleic acids before transformation to reflect the typical codon usage of the host without altering the polypeptide encoded by the non-natural DNA molecule. Codon optimization methods for optimum gene expression in heterologous hosts have been previously described (see, e.g., Welch et al., *PLoS One* 4:e7002, 2009; Gustafsson et al., *Trends Biotechnol.* 22:346, 2004; Wu et al., *Nucl. Acids Res.* 35:D76, 2007; Villalobos et al., *BMC Bioinformatics* 7:285, 2006; U.S. Patent Publication Nos. 2011/0111413 and 2008/0292918; disclosure of which methods are incorporated herein by reference, in their entirety). Exogenous nucleic acids encoding AB enzymes that are suitable for use in the practice of the present invention include those having a nucleic acid sequence that is at least about 85% identical to a nucleic acid reference sequence selected from the group consisting of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, and 149. Illustrative exogenous nucleic acids that encode a CB enzyme which are suitable for use in the practice of the invention include sequences which have been codon optimized for optimal expression in *Methylococcus capsulatus* Bath, such as, for example, any one of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, and 149.

Similarly, exogenous nucleic acid molecules of this disclosure encoding polypeptide variants may be designed using the phylogenetic-based methods described in the references noted above (U.S. Pat. No. 8,005,620; Gustafsson et al.; Welch et al.; Villalobos et al.; Minshull et al., all of which are incorporated herein by reference.).

An exogenous nucleic acid encoding an L-amino acid biosynthesis enzyme includes polynucleotides that encode a polypeptide, a polypeptide fragment, a peptide, or a fusion polypeptide that has or retains the corresponding L-amino acid biosynthesis enzyme activity. Methods to determine whether a polypeptide has a particular activity by measuring the ability of the polypeptide to convert a substrate into a product are known in the art.

In some embodiments, the exogenous nucleic acid encodes an expression control sequence that is operably linked to a nucleic acid encoding a native carbohydrate biosynthesis enzyme. Typically, the expression control sequence is one that results in the overexpression of a native L-amino acid biosynthesis enzyme.

When the first exogenous nucleic acid encodes an AB enzyme, it is typically operably linked to an exogenous expression control sequence. The exogenous expression control sequence may be operatively linked to the exogenous nucleic acid encoding the L-amino acid biosynthesis enzyme to enhance production of the desired L-amino acid. The exogenous expression control sequence is typically codon optimized for optimal expression from the $C_1$ metabolizing microorganism host cell.

In some embodiments, the first exogenous nucleic acid encodes an expression control sequence that is operably linked to a nucleic acid that encodes a native L-amino acid biosynthesis enzyme. Exemplary expression control sequences include the promoters described herein. In these embodiments, expression of a native L-amino acid biosynthesis enzyme is typically increased (i.e., overexpressed). Increased expression or activity includes expression or activity of a gene or protein being increased above the level of a wildtype (native or non-genetically engineered) control or reference microorganism. A gene or protein is overexpressed if the expression or activity is in a microorganism where it is not normally expressed or active. A gene or protein is overexpressed if the expression or activity is extended or present longer in the recombinant microorganism than in a wild-type control or reference microorganism. As used herein, "overexpressed" and "overexpression" when referring to a gene or a protein means an increase in expression or activity of the gene or protein. The terms "nucleic acid", "polynucleotide" and "gene" are used interchangeably herein to refer to a polymer of nucleic acid residues (e.g., deoxyribonucleotides or ribonucleotides) in either single- or double-stranded form.

In addition to the exogenous nucleic acids described hereinabove, recombinant $C_1$ metabolizing microorganisms of the present invention may comprise further genetic modifications which enhance the production of the desired L-amino acid. For example, the recombinant $C_1$ metabolizing microorganism of the present invention may further comprise an exogenous expression control sequence operatively linked to an endogenous nucleic acid encoding an endogenous enzyme that utilizes one or more of the same substrates utilized by L-amino acid biosynthesis enzymes, or utilizes the desired L-amino acid as a substrate (i.e., a "competing" endogenous enzyme). This may be done to downregulate the competing endogenous enzyme.

In some embodiments, it may be desirable to reduce or inhibit a competing endogenous enzyme activity by mutating the competing endogenous enzyme to delete or attenuate its activity. "Inhibit" or "inhibited," as used herein, refers to an alteration, reduction, down regulation, abrogation or deletion, directly or indirectly, in the expression of a target gene or in the activity of a target molecule relative to a control, endogenous or reference molecule, wherein the alteration, reduction, down regulation or abrogation is statistically, biologically, industrially, or clinically significant.

Various methods for downregulating, inactivating, knocking-out, or deleting endogenous gene function in $C_1$ metabolizing microorganisms are known in the art. For example, targeted gene disruption is an effective method for gene downregulation where an exogenous polynucleotide is inserted into a structural gene to disrupt transcription. Genetic cassettes comprising the exogenous insertion DNA (e.g., a genetic marker) flanked by sequence having a high degree of homology to a portion of the target host gene to be disrupted are introduced into the host $C_1$ metabolizing microorganism. Exogenous DNA disrupts the target host gene via native DNA replication mechanisms. Allelic exchange to construct deletion/insertional mutants in $C_1$ metabolizing microorganisms, including methanotrophic bacteria, have been described in, for example, Toyama and Lidstrom, *Microbiol.* 144:183, 1998; Stoylar et al., *Microbiol.* 145:1235, 1999; Ali et al., *Microbiol.* 152:2931, 2006; Van Dien et al., *Microbiol.* 149:601, 2003; Martin and Murrell, *FEMS Microbiol. Lett.* 127:243, 2006, all of which are incorporated herein by reference. For example, enzymes involved in other pathways, such as a carbohydrate synthesis pathway, may also be targeted for downregulation to focus metabolic activities of the host microorganism on L-amino acid biosynthesis.

The recombinant $C_1$ metabolizing microorganism may thus be engineered to have the ability to produce the desired L-amino acid at enhanced levels. In some of these embodiments, the recombinant $C_1$ metabolizing microorganism produces the desired L-amino acid at a level that is at least about 10% greater than that produced by the native $C_1$ metabolizing microorganism and up to about 2-fold, up to about 3-, 4-, 5-, 10-, 20-, 30-, 40-, 50-, 60-, 70-, 80-, 90-, 100-, and up to about 500- or about 1000-fold the level produced by the native $C_1$ metabolizing microorganism, when cultured in the presence of a natural gas-derived feedstock (e.g., natural gas, methane, and the like) under at least one set of culture conditions. In other embodiments, the recombinant $C_1$ metabolizing microorganism produces the desired L-amino acid at a level that is from at least about 15%, at least about 20%, at least about 25%, at least about 30%, at least about 35%, at least about 40%, at least about 45%, at least about 50%, at least 55%, at least about 60%, at least about 65%, at least about 70%, at least about 75%, at least about 80%, at least about 85%, at least about 90%, or is at least about 95% greater than that produced by the native $C_1$ metabolizing microorganism, and up to about 2-fold, up to about 3-, 4-, 5-, 10-, 20-, 30-, 40-, 50-, 60-, 70-, 80-, 90-, 100-, to about 500- or about 1000-fold the level produced by the native $C_1$ metabolizing microorganism, when cultured in the presence of a natural gas-derived feedstock under at least one set of culture conditions. Typically, the enhanced level of production of the desired L-amino acid by the recombinant $C_1$ metabolizing microorganism of the present invention is at least about 2-fold, 3-, 4-, 5-, 10-, 20-, 30-, 40-, 50-, 60-, 70-, 80-, 90-, or 100-fold that of the native $C_1$ metabolizing microorganism, when cultured in the presence of a natural gas-derived feedstock under at least one set of culture conditions.

Recombinant methods for expression of exogenous nucleic acids in microbial organisms are well known in the art. Such methods can be found described in, for example, Sambrook et al., *Molecular Cloning: A Laboratory Manual*, Third Ed., Cold Spring Harbor Laboratory, New York (2001); and Ausubel et al., *Current Protocols in Molecular Biology*, John Wiley and Sons, Baltimore, Md. (1999), all of which are incorporated herein by reference. Genetic modifications to nucleic acid molecules encoding enzymes, or functional fragments thereof, can confer a biochemical or metabolic capability to a recombinant cell that is altered from its naturally occurring state.

As used herein, the terms "endogenous" and "native" when referring to a nucleic acid, polypeptide, such as an enzyme, compound or activity refers to a nucleic acid, polypeptide, compound or activity that is normally present in a host cell. The term "homologous" or "homolog" refers to a molecule or activity from an exogenous (non-native) source that is the same or similar molecule or activity as that found in or derived from a host cell, species or strain.

As used herein, the terms "heterologous" and "exogenous" when referring to a nucleic acid molecule, construct or sequence refers to a nucleic acid molecule or portion of a nucleic acid molecule sequence that is not native to a cell in which it is expressed, a nucleic acid molecule or portion of a nucleic acid molecule native to a host cell that has been altered or mutated, or a nucleic acid molecule with an altered expression as compared to the native expression levels under similar conditions. For example, a heterologous control sequence (e.g., promoter, enhancer) may be used to regulate expression of a gene or a nucleic acid molecule in a way that is different than the gene or a nucleic acid molecule that is normally expressed in nature or culture. In certain embodiments, a heterologous nucleic acid molecule may be homologous to a native host cell gene, but may have an altered expression level or have a different sequence or both. In other embodiments, heterologous or exogenous nucleic acid molecules may not be endogenous to a host cell or host genome, but instead may have been added to a host cell by conjugation, transformation, transfection, electroporation, or the like, wherein the added molecule may integrate into the host genome or can exist as extra-chromosomal genetic material (e.g., plasmid or other self-replicating vector). The term "heterologous" when referring to an organism refers to a species that is different from the host cell.

In certain embodiments, more than one heterologous or exogenous nucleic acid molecule can be introduced into a host cell as separate nucleic acid molecules, as a polycistronic nucleic acid molecule, as a single nucleic acid molecule encoding a fusion protein, or any combination thereof, and still be considered as more than one heterologous or exogenous nucleic acid. For example, a $C_1$ metabolizing microorganism can be modified to express two or more heterologous or exogenous nucleic acid molecules, which may be the same or different, that encode one or more L-amino acid biosynthesis enzyme as disclosed herein. In certain embodiments, multiple copies of a L-amino acid biosynthesis enzyme-encoding polynucleotide molecule are introduced into a host cell, which may be two, three, four, five, six, seven, eight, nine, ten or more copies of the same L-amino acid biosynthesis enzyme or different L-amino acid biosynthesis enzyme encoding polynucleotides.

Host Cells and Transformation Methods

In carrying out the practice of the present invention, the exogenous nucleic acids described hereinabove are transformed into a host cell that is a $C_1$ metabolizing microorganism. The $C_1$ metabolizing microorganism employed may be natural, strain adapted (e.g., performing fermentation to select for strains with improved growth rates and increased total biomass yield compared to the parent strain), or recombinantly modified to produce or overexpress the L-amino acid biosynthesis enzyme of interest and/or to have increased growth rates. Typically, the $C_1$ metabolizing microorganism is a non-photosynthetic $C_1$ microorganism (e.g., is not an algae or a plant).

In certain embodiments, the present disclosure employs $C_1$ metabolizing microorganisms that are prokaryotes or bacteria, such as *Methylomonas, Methylobacter, Methylococcus, Methylosinus, Methylocystis, Methylomicrobium, Methanomonas, Methylophilus, Methylobacillus, Methylobacterium, Hyphomicrobium, Xanthobacter, Bacillus, Paracoccus, Nocardia, Arthrobacter, Rhodopseudomonas,* or *Pseudomonas.*

In further embodiments, the $C_1$ metabolizing bacteria employed is a methanotroph or a methylotroph. Exemplary methanotrophs include *Methylomonas, Methylobacter, Methylococcus, Methylosinus, Methylocystis, Methylomicrobium, Methanomonas, Methylocella,* or a combination thereof. Exemplary methylotrophs include *Methylobacterium extorquens, Methylobacterium radiotolerans, Methylobacterium populi, Methylobacterium chloromethanicum, Methylobacterium nodulans,* or a combination thereof. As used herein, the term "methylotrophic bacteria" refers to any bacteria capable of oxidizing any compound in any form (e.g., solid, liquid, gas) that contains at least one carbon and that do not contain carbon-carbon bonds. In certain embodiments, a methylotrophic bacterium may be a methanotroph. For example, "methanotrophic bacteria" refers to any methylotrophic bacteria that have the ability to oxidize methane as a source of carbon and energy, which may be the primary source of carbon and energy. Exemplary methanotrophic bacteria include *Methylomonas, Methylobacter, Methylococcus, Methylosinus, Methylocystis, Methylomicrobium,* or *Methanomonas.*

Methanotrophic bacteria are classified into three groups based on their carbon assimilation pathways and internal membrane structure: type I (gamma proteobacteria), type II (alpha proteobacteria, and type X (gamma proteobacteria). Type I methanotrophs use the ribulose monophosphate (RuMP) pathway for carbon assimilation whereas type II methanotrophs use the serine pathway. Type X methanotrophs use the RuMP pathway but also express low levels of enzymes of the serine pathway. Methanotrophic bacteria employed in the practice of the present invention include obligate methanotrophs, which can only utilize $C_1$ substrates for carbon and energy sources, and facultative methanotrophs, which naturally have the ability to utilize some multi-carbon substrates as a carbon and energy source.

Exemplary facultative methanotrophs employed in the practice of the present invention include some species of *Methylocella, Methylocystis,* and *Methylocapsa* (e.g., *Methylocella silvestris, Methylocella palustris, Methylocella tundrae, Methylocystis daltona* strain SB2, *Methylocystis bryophila,* and *Methylocapsa aurea* KYG), *Methylobacterium organophilum* (ATCC 27,886), *Methylibium petroleiphilum,* or high growth variants thereof. Exemplary obligate methanotrophic bacteria useful in the practice of the present invention include *Methylococcus capsulatus* Bath (NCIMB 11132), *Methylomonas* sp. 16a (ATCC PTA 2402), *Methylosinus trichosporium* OB3b (NRRL B-11,196), *Methylosinus sporium* (NRRL B-11,197), *Methylocystis parvus* (NRRL B-11,198), *Methylomonas methanica* (NRRL B-11,199), *Methylomonas albus* (NRRL B-11,200), *Methylobacter capsulatus* Y (NRRL B-11,201), *Methylomonas flagellata* sp. AJ-3670 (FERM P-2400), *Methylacidiphilum infernorum, Methylacidiphilum fumariolicum, Methylomicrobium alcaliphilum, Methyloacida kamchatkensis,* or high growth variants thereof.

Suitable $C_1$ metabolizing microorganisms useful in the practice of the present invention include syngas metabolizing bacteria such as, for example, *Clostridium, Moorella, Pyrococcus, Eubacterium, Desulfobacterium, Carboxydothermus, Acetogenium, Acetobacterium, Acetoanaerobium, Butyribaceterium, Peptostreptococcus,* and the like. Exemplary syngas metabolizing bacteria include *Clostridium autoethanogenum, Clostridium ljungdahli, Clostridium ragsdalei, Clostridium carboxydivorans, Butyribacterium methylotrophicum, Clostridium woodii, Clostridium neopropanologen,* and the like.

Other suitable $C_1$ metabolizing microorganisms useful in the practice of the present invention include eukaryotes such as, for example, yeast, including *Candida, Yarrowia, Hansenula, Pichia, Torulopsis, Rhodotorula,* and the like.

Each of the microorganisms of this disclosure may be grown as an isolated culture, with a heterologous organism that may aid with growth, or one or more of these bacteria may be combined to generate a mixed culture. In still further embodiments, $C_1$ metabolizing non-photosynthetic microorganisms of this disclosure are obligate $C_1$ metabolizing non-photosynthetic microorganisms, such as an obligate methanotroph or methylotroph.

Any one of the aforementioned $C_1$ metabolizing microorganisms can be used as a parent or reference host cell to make a recombinant $C_1$ metabolizing microorganisms of this disclosure. As used herein, "recombinant" refers to a non-naturally-occurring organism, microorganism, cell, nucleic acid molecule, or vector that has at least one genetic alteration or has been modified by the introduction of a heterologous nucleic acid molecule, or refers to a cell that has been altered such that the expression of an endogenous nucleic acid molecule or gene can be controlled. Recombinant also refers to a cell that is derived from a cell or is progeny of a cell having one or more such modifications. Genetic alterations include, for example, modifications introducing expressible nucleic acid molecules encoding proteins or enzymes, or other nucleic acid molecule additions, deletions, substitutions or other functional alteration of a cell's genetic material. For example, recombinant cells may express genes or other nucleic acid molecules that are not found in identical form within the native cell (i.e., unmodified or wild type cell), or may provide an altered expression pattern of endogenous genes, such genes that may otherwise be over-expressed, under-expressed, minimally expressed, or not expressed at all.

Any of the recombinant $C_1$ metabolizing microorganisms or methanotrophic bacteria described herein may be transformed to comprise at least one exogenous nucleic acid to provide the host with a new or enhanced activity (e.g., enzymatic activity) or may be genetically modified to remove or substantially reduce an endogenous gene function using any of a variety of methods known in the art.

Transformation refers to the introduction of a nucleic acid molecule (e.g., exogenous or heterologous nucleic acid molecule) into a host cell. The transformed host cell may carry the exogenous or heterologous nucleic acid molecule extra-chromosomally or integrated in the chromosome. Integration into a host cell genome and self-replicating vectors generally result in genetically stable inheritance of the transformed nucleic acid molecule. Host cells containing the transformed nucleic acid molecules are referred to as "non-naturally occurring" or "genetically engineered" or "recombinant" or "transformed" or "transgenic" cells (e.g., bacteria).

Expression systems and expression vectors useful for the expression of heterologous nucleic acids in $C_1$ metabolizing microorganisms (e.g., methanotrophic bacteria) are known.

Electroporation of $C_1$ metabolizing bacteria is described herein and has been previously described in, for example, Toyama et al., *FEMS Microbiol. Lett.* 166:1, 1998; Kim and Wood, *Appl. Microbiol. Biotechnol.* 48:105, 1997; Yoshida et al., *Biotechnol. Lett.* 23:787, 2001, and U.S. Patent Appl. Pub. No. 2008/0026005.

Bacterial conjugation, which refers to a particular type of transformation involving direct contact of donor and recipient cells, is more frequently used for the transfer of nucleic acid molecules into $C_1$ metabolizing bacteria. Bacterial conjugation involves mixing "donor" and "recipient" cells together in close contact with each other. Conjugation occurs by formation of cytoplasmic connections between donor and recipient bacteria, with unidirectional transfer of newly synthesized donor nucleic acid molecules into the recipient cells. A recipient in a conjugation reaction is any cell that can accept nucleic acids through horizontal transfer from a donor bacterium. A donor in a conjugation reaction is a bacterium that contains a conjugative plasmid, conjugative transposon, or mobilized plasmid. The physical transfer of the donor plasmid can occur through a self-transmissible plasmid or with the assistance of a "helper" plasmid. Conjugations involving $C_1$ metabolizing bacteria is described herein and have been previously described in Stolyar et al., *Mikrobiologiya* 64:686, 1995; Motoyama et al., *Appl. Micro. Biotech.* 42:67, 1994; Lloyd et al., *Arch. Microbiol.* 171:364, 1999; PCT Publication No. WO 02/18617; and Ali et al., *Microbiol.* 152:2931, 2006.

Expression control sequences suitable for use in the practice of the present invention include, for example, promoters, terminators, enhancers, repressors, inducers, and the like. Promoters suitable for use in the practice of the present invention may be constitutive, leaky, or inducible, and native or non-native to the host cell employed. Exemplary promoters include a pyruvate decarboxylase (PDC) a promoter, a deoxy-xylulose phosphate synthase promoter, a methanol dehydrogenase promoter (MDH) (such as, for example, the promoter in the upstream intergenic region of the mxaF gene from *Methylococcus capsulatus* Bath (Acc. No. MCA0779) or the MDH promoter from *M. extorquens* (See Springer et al., *FEMS Microbiol. Lett.* 160:119 (1998)), a hexulose 6-phosphate synthase promoter, a ribosomal protein S16 promoter, a serine hydroxymethyl transferase promoter, a serine-glyoxylate aminotransferase promoter, a phosphoenolpyruvate carboxylase promoter, a T5 promoter, Trc promoter, a promoter for PHA synthesis (Foellner et al., *Appl. Microbiol. Biotechnol.* 40:284, 1993), a pyruvate decarboxylase promoter (Tokuhiro et al., *Appl. Biochem. Biotechnol.* 131:795, 2006), the lac operon Plac promoter (Toyama et al., *Microbiol.* 143:595, 1997), a hybrid promoter such as Ptrc (Brosius et al., *Gene* 27:161, 1984), promoters identified from native plasmid in methylotrophs (EP 296484), methanotrophs, and the like.

Additionally, suitable homologous or heterologous promoters for high expression of exogenous nucleic acid molecules may be utilized. For example, U.S. Pat. No. 7,098,005 describes the use of promoters for high expression in the presence of methane or methanol of a heterologous coding nucleic acid in $C_1$ metabolizing bacteria.

In certain embodiments, regulated expression of exogenous nucleic acids encoding an L-amino acid biosynthesis enzyme may be desirable to optimize growth rate of the non-naturally occurring $C_1$ metabolizing microorganism and may improve bacterial growth in a variety of carbon source conditions. This may be achieved through the use of an inducible promoter system.

In certain embodiments, a nucleic acid encoding AB enzyme is operatively linked to an inducible promoter. Inducible promoter systems employed in the practice of the present invention include those known in the art and include tetracycline inducible promoter system; IPTG/lac operon inducible promoter system, heat shock inducible promoter system; metal-responsive promoter systems; nitrate inducible promoter system; light inducible promoter system; ecdysone inducible promoter system, the inducible/regulatable system described for use in methylotrophic and methanotrophic bacteria (see, e.g., U.S. Patent Appl. No. US 2010/0221813, which is incorporated herein by reference), and the like. For example, in one embodiment, the non-naturally occurring $C_1$ metabolizing microorganism (e.g., methanotroph, methylotroph) comprises: (1) an exogenous nucleic acid encoding AB enzyme, operatively linked to a promoter flanked by lacO operator sequences, and (2) an exogenous nucleic acid encoding a lad repressor protein operatively linked to a constitutive promoter (e.g., hexulose-6-phosphate synthase promoter). Induction is initiated when Lad repressor protein binds to lacO operator sequences flanking the LDH or other promoter, preventing transcription. IPTG binds lad repressor and releases it from lacO sequences, allowing transcription. By using an inducible promoter system, lactate synthesis may be controlled by the addition of an inducer.

The expression systems and expression vectors employed in the practice of the present invention optionally contain genetic elements, such as, for example, one or more ribosome binding sites for translation initiation and a transcription termination site, polyadenylation signals, restriction enzyme sites, multiple cloning sites, other coding segments, and the like. In certain embodiments, promoters and/or codon optimization (described in more detail hereinabove) are used for high constitutive expression of exogenous polynucleotides encoding one or more carbohydrate biosynthesis enzymes in host methanotrophic bacteria. Regulated expression of an exogenous nucleic acid in a host methanotrophic bacterium may also be utilized. For example, an inducible/regulatable system of recombinant protein expression in methylotrophic and methanotrophic bacteria as described in, for example, U.S. Patent Appl. No. US 2010/0221813 may be used.

In certain embodiments, promoters or codon optimization (described in more detail hereinabove) are used for high constitutive expression of exogenous polynucleotides encoding one or more L-amino acid biosynthesis enzymes in host methanotrophic bacteria. Regulated expression of an exogenous nucleic acid in a host methanotrophic bacterium may also be utilized. For example, an inducible/regulatable system of recombinant protein expression in methylotrophic and methanotrophic bacteria as described in, for example, U.S. Patent Appl. No. US 2010/0221813 may be used.

Methods of Producing a Desired L-Amino Acid

The present invention provides a method of producing a L-amino acid, said method comprising culturing a recombinant $C_1$ metabolizing microorganism in the presence of a natural gas-derived carbon feedstock under conditions sufficient to produce the L-amino acid, wherein the $C_1$ metabolizing microorganism comprises an exogenous nucleic acid encoding a L-amino acid biosynthesis enzyme. Typically, the natural gas-derived carbon feedstock is natural gas, methane, or syngas. Illustrative conditions suitable for culturing the microorganisms of the present invention are described in the Examples.

A variety of culture methodologies may be used for the microorganisms described herein. For example, $C_1$ metabolizing microorganisms (such as methanotroph or methylotroph bacteria) may be grown by batch culture or continuous culture methodologies. In certain embodiments, the cultures are grown in a controlled culture unit, such as a fermentor, bioreactor, hollow fiber cell, or the like. Generally cells in log phase are often responsible for the bulk production of a product or intermediate of interest in some systems, whereas stationary or post-exponential phase production can be obtained in other systems.

A classical batch culturing method is a closed system in which the media composition is set when the culture is started and is not altered during the culture process. That is, media is inoculated at the beginning of the culturing process with one or more microorganisms of choice and then are allowed to grow without adding anything to the system. As used herein, a "batch" culture is in reference to not changing the amount of a particular carbon source initially added, whereas control of factors such as pH and oxygen concentration can be monitored and altered during the culture. In batch systems, metabolite and biomass compositions of the system change constantly up to the time the culture is terminated. Within batch cultures, cells (e.g., bacteria such as methylotrophs) will generally move from a static lag phase to a high growth logarithmic phase to a stationary phase where growth rate is reduced or stopped (and will eventually lead to cell death if conditions do not change).

A fed-batch system is a variation on the standard batch system in which a carbon substrate of interest is added in increments as the culture progresses. Fed-batch systems are useful when cell metabolism is likely to be inhibited by catabolite repression and when it is desirable to have limited amounts of substrate in the media. Since it is difficult to measure actual substrate concentration in fed-batch systems, an estimate is made based on changes of measureable factors such as pH, dissolved oxygen, and the partial pressure of waste gases. Batch and fed-batch culturing methods are common and known in the art (see, e.g., Thomas D. Brock, Biotechnology: A Textbook of Industrial Microbiology, $2^{nd}$ Ed. (1989) Sinauer Associates, Inc., Sunderland, Mass.; Deshpande, *Appl. Biochem. Biotechnol.* 36:227, 1992).

Continuous cultures are "open" systems in the sense that defined culture media is continuously added to a bioreactor while an equal amount of used ("conditioned") media is removed simultaneously for processing. Continuous cultures generally maintain the cells at a constant high, liquid phase density where cells are primarily in logarithmic growth phase. Alternatively, continuous culture may be practiced with immobilized cells (e.g., biofilm) where carbon and nutrients are continuously added and valuable products, by-products, and waste products are continuously removed from the cell mass. Cell immobilization may be achieved with a wide range of solid supports composed of natural materials, synthetic materials, or a combination thereof.

Continuous or semi-continuous culture allows for the modulation of one or more factors that affect cell growth or end product concentration. For example, one method may maintain a limited nutrient at a fixed rate (e.g., carbon source, nitrogen) and allow all other parameters to change over time. In other embodiments, several factors affecting growth may be continuously altered while cell concentration, as measured by media turbidity, is kept constant. The goal of a continuous culture system is to maintain steady state growth conditions while balancing cell loss due to media being drawn off against the cell growth rate. Methods of modulating nutrients and growth factors for continuous culture processes and techniques for maximizing the rate of product formation are well known in the art (see Brock, 1992).

Liquid phase bioreactors (e.g., stirred tank, packed bed, one liquid phase, two liquid phase, hollow fiber membrane) are well known in the art and may be used for growth of non-naturally occurring microorganisms and biocatalysis.

By using gas phase bioreactors, substrates for bioproduction are absorbed from a gas by non-naturally occurring microorganisms, cell lysates or cell-free fractions thereof, rather than from a liquid. Use of gas phase bioreactors with microorganisms is known in the art (e.g., U.S. Pat. Nos. 2,793,096; 4,999,302; 5,585,266; 5,079,168; and 6,143,556; U.S. Statutory Invention Registration H1430; U.S. Patent Application Publication No. 2003/0032170; *Emerging Technologies in Hazardous Waste Management III*, 1993, eds. Tedder and Pohland, pp 411-428). Exemplary gas phase bioreactors include single pass system, closed loop pumping system, and fluidized bed reactor. By utilizing gas phase bioreactors, methane or other gaseous substrates are readily available for bioconversion by polypeptides with, for example, monooxygenase activity. In certain embodiments, methods for converting a gas into a L-amino acid are performed in gas phase bioreactors. In further embodiments, methods for converting a gas into a L-amino acid are performed in fluidized bed reactors. In a fluidized bed reactor, a fluid (i.e., gas or liquid) is passed upward through particle bed carriers, usually sand, granular-activated carbon, or diatomaceous earth, on which microorganisms can attach and grow. The fluid velocity is such that particle bed carriers and attached microorganisms are suspended (i.e., bed fluidization). The microorganisms attached to the particle bed carriers freely circulate in the fluid, allowing for effective mass transfer of substrates in the fluid to the microorganisms and increased microbial growth. Exemplary fluidized bed reactors include plug-flow reactors and completely mixed reactors. Uses of fluidized bed reactors with microbial biofilms are known in the art (e.g., Pfluger et al., *Bioresource Technol.* 102:9919, 2011; Fennell et al., *Biotechnol, Bioengin.* 40:1218, 1992; Ruggeri et al., *Water Sci. Technol.* 29:347, 1994; U.S. Pat. Nos. 4,032,407; 4,009,098; 4,009,105; and 3,846,289).

Recombinant $C_1$ metabolizing microorganisms described in the present disclosure may be grown as an isolated pure culture, with a heterologous non-$C_1$ metabolizing microorganism(s) that may aid with growth, or with one or more different strains or species of $C_1$ metabolizing microorganisms may be combined to generate a mixed culture.

In certain embodiments, L-amino acids of the present invention are produced during a specific phase of cell growth (e.g., lag phase, log phase, stationary phase, or death phase). It may be desirable for carbon from feedstock to be converted to the L-amino acid rather than to growth and maintenance of $C_1$ metabolizing microorganism. In some embodiments, non-naturally occurring $C_1$ metabolizing microorganism (e.g., methanotrophs, methylotrophs) as provided herein are cultured to a low to medium cell density ($OD_{600}$) and then production of L-amino acid is initiated. In some embodiments, a L-amino acid is produced while methanotrophic bacteria are no longer dividing or dividing very slowly. In some embodiments, the L-amino acid is produced only during stationary phase. In some embodiments, the L-amino acid is produced during log phase and stationary phase.

The fermenter composition comprising the L-amino acid produced by a recombinant $C_1$ metabolizing microorganism (e.g., methanotrophs, methylotrophs) provided herein may further comprise other organic compounds associated with biological fermentation processes. For example, biological by-products of fermentation may include one or more of alcohols, epoxides, aldehydes, ketones, esters, or a combination thereof. In certain embodiments, the fermenter composition may contain one or more of the following alcohols: methanol, ethanol, butanol, or propanol. Other compounds, such as $H_2O$, CO, $CO_2$, $CON_2$, $H_2$, $O_2$, and unutilized carbon feedstocks, such as methane, ethane, propane, and butane, may also be present in the fermenter off-gas.

In certain embodiments, the recombinant $C_1$ metabolizing microorganisms (e.g., methanotrophs, methylotrophs) provided herein produce a L-amino acid of the present invention at about 0.001 g/L of culture to about 500 g/L of culture. In some embodiments, the amount of L-amino acid produced is about 1 g/L of culture to about 100 g/L of culture. In some embodiments, the amount of L-amino acid produced is about 0.001 g/L, 0.01 g/L, 0.025 g/L, 0.05 g/L, 0.1 g/L, 0.15 g/L, 0.2 g/L, 0.25 g/L, 0.3 g/L, 0.4 g/L, 0.5 g/L, 0.6 g/L, 0.7 g/L, 0.8 g/L, 0.9 g/L, 1 g/L, 2.5 g/L, 5 g/L, 7.5 g/L, 10 g/L, 12.5 g/L, 15 g/L, 20 g/L, 25 g/L, 30 g/L, 35 g/L, 40 g/L, 45 g/L, 50 g/L, 60 g/L, 70 g/L, 80 g/L, 90 g/L, 100 g/L, 125 g/L, 150 g/L, 175 g/L, 200 g/L, 225 g/L, 250 g/L, 275 g/L, 300 g/L, 325 g/L, 350 g/L, 375 g/L, 400 g/L, 425 g/L, 450 g/L, 475 g/L, or 500 g/L.

Products

The present disclosure provides other useful products in addition to recombinant $C_1$ metabolizing cells as disclosed herein. In one embodiment, the present disclosure provides a biomass derived from a culture of the recombinant $C_1$ metabolizing microorganism of the present invention. In a specific embodiment, the present disclosure provides a biomass comprising a recombinant $C_1$ metabolizing microorganism, wherein the recombinant $C_1$ metabolizing microorganism comprises an exogenous nucleic acid encoding a L-amino acid biosynthesis enzyme and wherein the recombinant $C_1$ metabolizing microorganism is capable of converting a natural gas-derived feedstock into a desired L-amino acid. In a further embodiment, the present invention provides a biomass comprising a recombinant $C_1$ metabolizing microorganism, wherein the recombinant $C_1$ metabolizing microorganism comprises an exogenous nucleic acid encoding a L-amino acid biosynthesis enzyme and wherein the recombinant $C_1$ metabolizing microorganism is capable of converting methane into a desired L-amino acid.

As used herein, "biomass" refers to organic material having a biological origin, which may include one or more of whole cells, lysed cells, extracellular material, or the like. For example, the material harvested from a cultured microorganism (e.g., bacterial or yeast culture) is considered the biomass, which can include cells, cell membranes, cell cytoplasm, inclusion bodies, products secreted or excreted into the culture medium, or any combination thereof. In certain embodiments, biomass comprises the $C_1$ metabolizing microorganisms of this disclosure together with the media of the culture in which the $C_1$ metabolizing microorganisms of this disclosure were grown. In other embodiments, biomass comprises a $C_1$ metabolizing microorganisms (whole or lysed or both) of this disclosure recovered from a culture grown on a $C_1$ substrate (e.g., natural gas, methane, and the like). In still other embodiments, biomass comprises the spent media supernatant from a culture of $C_1$ metabolizing microorganism cultured on a $C_1$ substrate. Such a culture may be considered a renewable resource. Biomass of the present invention is enriched with respect to levels of the desired L-amino acid.

Recombinant $C_1$ metabolizing microorganisms of the present invention which are provided with a natural gas-derived substrate for cell growth are distinctive with respect to their carbon fingerprint as represented by their $\delta^{13}C$ values (as are the products derived from such recombinant $C_1$ metabolizing microorganisms). By way of background, stable isotopic measurements and mass balance approaches are widely used to evaluate global sources and sinks of methane (see Whiticar and Faber, Org. Geochem. 10:759, 1986; Whiticar, Org. Geochem. 16: 531, 1990). To use $\delta^{13}C$ values of residual methane to determine the amount oxidized, it is necessary to know the degree of isotopic fractionation caused by microbial oxidation of methane. For example, aerobic methanotrophs can metabolize methane through a specific enzyme, methane monooxygenase (MMO). Methanotrophs convert methane to methanol and subsequently formaldehyde. Formaldehyde can be further oxidized to $CO_2$ to provide energy to the cell in the form of reducing equivalents (NADH), or incorporated into biomass through either the RuMP or Serine cycles (Hanson and Hanson, Microbiol. Rev. 60:439, 1996), which are directly analogous to carbon assimilation pathways in photosynthetic organisms. More specifically, a Type I methanotroph uses the RuMP pathway for biomass synthesis and generates biomass entirely from $CH_4$, whereas a Type II methanotroph uses the serine pathway that assimilates 50-70% of the cell carbon from $CH_4$ and 30-50% from $CO_2$ (Hanson and Hanson, 1996). Methods for measuring carbon isotope compositions are provided in, for example, Templeton et al. (Geochim. Cosmochim. Acta 70:1739, 2006), which methods are hereby incorporated by reference in their entirety. Example 2 describes the characterization of stable carbon isotope distribution in the cells of different $C_1$ metabolizing microorganisms. The highly negative $\delta^{13}C$ values for the cells was similarly reflected in the $\delta^{13}C$ values of compounds extracted from these cells as described in the Examples. The $\delta^{13}C$ of the invention products described herein (i.e., a recombinant $C_1$ metabolizing microorganism of the present invention (as described hereinabove), related biomass and L-amino acids and compositions derived therefrom) can vary depending on the source and purity of the $C_1$ substrate used, as demonstrated in Example 3.

In certain embodiments, the recombinant $C_1$ metabolizing microorganism of the present invention, and related biomass and L-amino acids and composition derived therefrom, exhibit a $\delta^{13}C$ of less than −30‰, less than −31‰, less than −32‰, less than −33‰, less than −34‰, less than −35‰, less than −36‰, less than −37‰, less than −38‰, less than −39‰, less than −40‰, less than −41‰, less than −42‰, less than −43‰, less than −44‰, less than −45‰, less than −46‰, less than −47‰, less than −48‰, less than −49‰, less than −50‰, less than −51‰, less than −52‰, less than −53‰, less than −54‰, less than −55‰, less than −56‰, less than −57‰, less than −58‰, less than −59‰, less than −60‰, less than −61‰, less than −62‰, less than −63‰, less than −64‰, less than −65‰, less than −66‰, less than −67‰, less than −68‰, less than −69‰, or less than −70‰.

In certain embodiments, a recombinant $C_1$ metabolizing microorganism of the present invention, and related biomass and L-amino acids and composition derived therefrom, exhibit a $\delta^{13}C$ of about −35‰ to about −50‰, −45‰ to about −35‰, or about −50‰ to about −40‰, or about −45‰ to about −65‰, or about −60‰ to about −70‰, or about −30‰ to about −70‰.

In further embodiments, a $C_1$ metabolizing non-photosynthetic microorganism biomass has a $\delta^{13}C$ of less than about −30‰, or ranges from about −40‰ to about −60‰. In certain embodiments, the biomass comprises a recombinant $C_1$ metabolizing non-photosynthetic microorganism together with the spent media, or the biomass comprises a spent media supernatant composition from a culture of a recombinant $C_1$ metabolizing non-photosynthetic microorganism, wherein the $\delta^{13}C$ of the biomass is less than about −30‰. In certain other embodiments, the L-amino acid composition is extracted or concentrated from a biomass, which can comprise recombinant $C_1$ metabolizing non-photosynthetic microorganisms together with the spent media from a culture, or a spent media supernatant composition from a culture of a recombinant $C_1$ metabolizing non-photosynthetic microorganism.

In certain embodiments, a L-amino acid composition derived from a $C_1$ metabolizing microorganism (which may optionally be an extract or isolate from the $C_1$ metabolizing microorganism biomass) comprises hydrogen, oxygen, and carbon atoms of at least about 50% to about 80% of the weight of the composition, and wherein the $\delta^{13}C$ of the composition is less than about −35‰ or less than about −36‰ or less than about −37‰ or less than about −38‰ or less than about −39‰ or less than about −40‰. In certain embodiments, an L-amino acid composition derived therefrom comprises molecules having hydrogen, oxygen, and carbon atoms, wherein the hydrogen, oxygen, and carbon atoms are at least 50%, at least 55%, at least 60%, at least 65%, at least 70%, at least 75%, or at least 80%, or at least 90%, or at least 95% of the weight of the composition and wherein the $\delta^{13}C$ of the composition ranges from about −30‰ to about −70‰, or wherein the $\delta^{13}C$ in the biomass decreases as cell density increases by about −5‰ to about −20‰, or wherein the $\delta^{13}C$ of the biomass is higher than that of $CO_2$ produced at the same time by an average of 5‰ to 15‰ when cultured in the presence or absence of copper.

Characterization of $\delta^{13}C$ of some $C_1$ metabolizing microorganisms cultivated in the presence of a natural gas-derived feedstock is illustrated in the examples, hereinbelow.

The present invention further provides an animal feed comprising the recombinant $C_1$ metabolizing microorganism, related biomass, and/or L-amino acid composition of the present invention. As contemplated in the practice of the present invention, the animal feed may be a livestock feed (such as, for example, pig feed, cattle feed, sheep feed, and the like), a poultry feed (such as, for example, chicken feed, turkey feed, and the like), or a fish feed (such as, for example, salmon feed, shell fish feed, and the like). The animal feed may further comprise an additive, such as, for example, a plant derived material (including, for example, those derived from grains such as, for example, corn, barley, oats, rice, rye, wheat, sorghum, Brewer's spent grain, and the like; and those derived from legumes, such as, for example, alfalfa, clover, peas, beans, lentils, soybeans, and the like), an animal-derived material (such as, for example, fish meal), and/or a microorganism-derived material (including, for example, biomass from a heterologous microorganism that may be, for example, a bacteria, a yeast, or an algae). In some embodiments, the plant-derived material additive is soy meal or pea protein.

In a further embodiment, the present invention provides a culture or fermentation medium comprising a recombinant $C_1$ metabolizing microorganism, related biomass, and/or L-amino acid composition of the present invention. Typically, the culture or fermentation medium further comprises a carbohydrate (e.g., a sugar, and the like) and/or water. In an additional embodiment, the present invention provides a cell culture composition comprising the invention culture or fermentation medium, and a second microorganism. Typically, a second microorganism is a bacteria, a yeast, or an algal cell.

Embodiments of the invention include the following:

1. A biomass derived from a culture of a recombinant $C_1$ metabolizing microorganism, wherein the recombinant $C_1$ metabolizing microorganism comprises an exogenous nucleic acid encoding an L-amino acid biosynthesis enzyme, wherein the $C_1$ metabolizing microorganism is capable of converting a natural gas-derived carbon feedstock into the L-amino acid, and wherein the $\delta^{13}C$ of the biomass is less than −40‰.

2. The biomass of embodiment 1, wherein the recombinant $C_1$ metabolizing microorganism is a non-photosynthetic $C_1$ metabolizing microorganism.

3. The biomass according to any of embodiments 1-2, wherein the exogenous nucleic acid encodes an enzyme selected from the group consisting of a lysine biosynthesis enzyme, a tryptophan biosynthesis enzyme, a methionine biosynthesis enzyme, a cysteine biosynthesis enzyme, and a threonine biosynthesis enzyme.

4. The biomass according to any of embodiments 1-3, wherein the exogenous nucleic acid encodes a lysine biosynthesis enzyme selected from the group consisting of a lysine-sensitive aspartokinase III (lysC), an aspartate kinase, an aspartate-semialdehyde dehydrogenase (asd), a dihydrodipicolinate synthase (dapA), a dihydrodipicolinate reductase (dapB), a 2,3,4,5-tetrahydropyridine-2,6-carboxylate N-succinyltransferase (dapD), an acetylornithine/succinyldiaminopimelate aminotransferase (argD), a succinyl-diaminopimelate desuccinylase (dapE), a succinyldiaminopimelate transaminase, a diaminopimelate epimerase (dapF), and a diaminopimetate dicarboxylase (lysA).

5. The biomass according to embodiment 4, wherein the L-amino acid is L-lysine.

6. The biomass according to any of embodiments 1-3, wherein the exogenous nucleic acid encodes a tryptophan biosynthesis enzyme selected from the group consisting of a chorismate-pyruvate lyase (ubiC), an anthranilate synthase component I (trpE), an anthranilate synthase component II (trpG), an anthranilate phosphoribosyltransferase (trpD), a phosphoribosylanthranilate isomerase (trpC), a tryptophan biosynthesis protein (trpC), an N-(5'phosphoribosyl)anthranilate isomerase (trpF), an indole-3-glycerol phosphate synthase, a tryptophan synthase alpha chain (trpA), and a tryptophan synthase beta chain (trpB).

7. The biomass according to embodiment 6, wherein the L-amino acid is L-tryptophan.

8. The biomass according to any of embodiments 1-3, wherein exogenous nucleic acid encodes a methionine biosynthesis enzyme selected from the group consisting of a homoserine O-succinyltransferase (metA), a cystathionine gamma-synthase (metB), a protein MalY, a cystathionine beta-lyase (metC), a B12-dependent methionine synthase (metH), and a 5-methyltetrahydropteroyltriglutamate-homocysteine S-methyltransferase (metE).

9. The biomass according to embodiment 8, wherein the L-amino acid is L-methionine.

10. The biomass according to any of embodiments 1-3, wherein the exogenous nucleic acid encodes a cysteine biosynthesis enzyme selected from the group consisting of a serine acetyltransferase (CysE) a cysteine synthase A, and a cysteine synthase B.

11. The biomass according to embodiment 10, wherein the L-amino acid is L-cysteine.

12. The biomass according to any of embodiments 1-3, wherein the exogenous nucleic acid encodes a threonine biosynthesis enzyme selected from the group consisting of an aspartate transaminase, a PLP-dependent aminotransferase, an aspartate aminotransferase, an aspartate kinase, an aspartate-semialdehyde dehydrogenase, a homoserine dehydrogenase, a homoserine kinase, and a threonine synthase.

13. The biomass of embodiment 12, wherein the L-amino acid is L-threonine.

14. The biomass according to any of embodiments 1-13, wherein the exogenous nucleic acid encodes an L-amino acid biosynthesis enzyme that is endogenous to a microorganism selected from the group consisting of *E. coli* and *C. glutamicum*.

15. The biomass according to any of embodiments 1-2, wherein the exogenous nucleic acid encodes an L-amino acid biosynthesis enzyme sequence selected from the group consisting of any one of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, or 150.

16. The biomass according to any of embodiments 1-15, wherein the sequence of the exogenous nucleic acid is codon optimized for optimal expression from the recombinant $C_1$ metabolizing microorganism.

17. The biomass of any of embodiments 1-16, wherein the exogenous nucleic acid encoding the L-amino acid biosynthesis enzyme is operatively linked to an expression control sequence.

18. The biomass of embodiment 17, wherein the expression control sequence is an exogenous expression control sequence.

19. The biomass of any of embodiments 1-18, wherein the $C_1$ metabolizing microorganism further comprises a deletion of an endogenous enzyme activity.

20. The biomass according to any of embodiments 1-19, wherein the $C_1$ metabolizing microorganism is a methanotroph.

21. The biomass according to embodiment 20, wherein the methanotroph is *Methylomonas*, *Methylobacter*, *Methylococcus*, *Methylosinus*, *Methylocystis*, *Methylomicrobium*, *Methanomonas*, *Methylocella*, or *Methylocapsa*.

22. The biomass of embodiment 20, wherein the methanotroph is selected from the group consisting of *Methylococcus capsulatus* Bath strain, *Methylomonas methanica* 16a (ATCC PTA 2402), *Methylosinus trichosporium* OB3b (NRRL B-11,196), *Methylosinus sporium* (NRRL B-11, 197), *Methylocystis parvus* (NRRL B-11,198), *Methylomonas methanica* (NRRL B-11,199), *Methylomonas albus* (NRRL B-11,200), *Methylobacter capsulatus* (NRRL B-11, 201), *Methylobacterium organophilum* (ATCC 27,886), *Methylomonas* sp AJ-3670 (FERM P-2400), *Methylocella silvestris*, *Methylocella palustris* (ATCC 700799), *Methylocella tundrae*, *Methylocystis daltona* strain SB2, *Methylocystis bryophila*, *Methylocapsa aurea* KYG, *Methylacidiphilum infernorum*, *Methylibium petroleiphilum*, and *Methylomicrobium alcaliphilum*.

23. The biomass according to any one of embodiments 1-22, wherein the natural gas-derived carbon feedstock is selected from the group consisting of natural gas, syngas, methane, methanol, formaldehyde, formic acid, carbon monoxide, carbon dioxide, cyanide, a methylamine, a methylthiol, a methylhalogen, and any combination or two or more thereof.

24. The biomass of embodiment 23, wherein the natural gas-derived carbon feedstock is natural gas.

25. The biomass of embodiment 23, wherein the natural gas-derived carbon feedstock is methane.

26. The biomass of embodiment 23, wherein the natural gas-derived carbon feedstock is syngas.

27. The biomass of embodiment 23, wherein the $C_1$ metabolizing microorganism is a syngas metabolizing bacteria.

28. The biomass according to embodiment 27, wherein the syngas metabolizing bacteria is selected from the group consisting of *Clostridium autoethanogenum*, *Clostridium ljungdahli*, *Clostridium ragsdalei*, *Clostridium carboxydivorans*, *Butyridbacterium methylotrophicum*, *Clostridium woodii*, and *Clostridium neopropanologen*.

29. The biomass according to any of embodiments 1-28, wherein the $\delta^{13}C$ of the biomass is less than −50‰.

30. A composition comprising an L-amino acid, wherein the composition exhibits a $\delta^{13}C$ of less than −40‰.

31. The composition of embodiment 30, wherein the L-amino acid is selected from the group consisting of L-lysine, L-tryptophan, L-methionine, L-cysteine, and L-threonine.

32. An animal feed comprising the biomass of any of embodiments 1-29 or the composition of any of embodiments 30-31.

33. The animal feed of embodiment 32, further comprising a plant-derived material.

34. The animal feed of embodiment 33, wherein the plant-derived material is selected from the group consisting of soybean meal and pea protein.

35. A culture or fermentation medium comprising the biomass of any of embodiments 1-27 or the composition of any of embodiments 40-42.

36. A recombinant $C_1$ metabolizing microorganism comprising an exogenous nucleic acid encoding an L-amino acid biosynthesis enzyme, wherein the $C_1$ metabolizing microorganism is capable of converting a natural gas-derived carbon feedstock into the L-amino acid, and wherein the $\delta^{13}C$ of the biomass is less than −40‰/

37. The recombinant $C_1$ metabolizing microorganism of embodiment 36, wherein the recombinant $C_1$ metabolizing microorganism is a non-photosynthetic $C_1$ metabolizing microorganism.

38. The recombinant $C_1$ metabolizing microorganism according to any of embodiments 36-37, wherein the exogenous nucleic acid encodes an enzyme selected from the group consisting of a lysine biosynthesis enzyme, a tryptophan biosynthesis enzyme, a methionine biosynthesis enzyme, a cysteine biosynthesis enzyme, and a threonine biosynthesis enzyme.

39. The recombinant $C_1$ metabolizing microorganism according to any of embodiments 36-38, wherein the exogenous nucleic acid encodes a lysine biosynthesis enzyme selected from the group consisting of a lysine-sensitive aspartokinase III (lysC), an aspartate kinase, an aspartate-semialdehyde dehydrogenase (asd), a dihydrodipicolinate synthase (dapA), a dihydrodipicolinate reductase (dapB), a 2,3,4,5-tetrahydropyridine-2,6-carboxylate N-succinyltransferase (dapD), an acetylornithine/succinyldiaminopimelate aminotransferase (argD), a succinyl-diaminopimelate desuccinylase (dapE), a succinyldiaminopimelate transaminase, a diaminopimelate epimerase (dapF), and a diaminopimetate dicarboxylase (lysA).

40. The recombinant $C_1$ metabolizing microorganism according to embodiment 39, wherein the L-amino acid is L-lysine.

41. The recombinant $C_1$ metabolizing microorganism according to any of embodiments 36-38, wherein the exogenous nucleic acid encodes a tryptophan biosynthesis enzyme selected from the group consisting of a chorismate-pyruvate lyase (ubiC), an anthranilate synthase component I (trpE), an anthranilate synthase component II (trpG), an anthranilate phosphoribosyltransferase (trpD), a phosphoribosylanthranilate isomerase (trpC), a tryptophan biosynthesis protein (trpC), an N-(5'phosphoribosyl)anthranilate isomerase (trpF), an indole-3-glycerol phosphate synthase, a tryptophan synthase alpha chain (trpA), and a tryptophan synthase beta chain (trpB).

42. The recombinant $C_1$ metabolizing microorganism according to embodiment 41, wherein the L-amino acid is L-tryptophan.

43. The recombinant $C_1$ metabolizing microorganism according to any of embodiments 36-38, wherein exogenous nucleic acid encodes a methionine biosynthesis enzyme selected from the group consisting of a homoserine O-succinyltransferase (metA), a cystathionine gamma-synthase (metB), a protein MalY, a cystathionine beta-lyase (metC), a B12-dependent methionine synthase (metH), and a 5-methyltetrahydropteroyltriglutamate-homocysteine S-methyltransferase (metE).

44. The recombinant $C_1$ metabolizing microorganism according to embodiment 43, wherein the L-amino acid is L-methionine.

45. The recombinant $C_1$ metabolizing microorganism according to any of embodiments 36-38, wherein the exogenous nucleic acid encodes a cysteine biosynthesis enzyme selected from the group consisting of a serine acetyltransferase (CysE) a cysteine synthase A, and a cysteine synthase B.

46. The recombinant $C_1$ metabolizing microorganism according to embodiment 45, wherein the L-amino acid is L-cysteine.

47. The recombinant $C_1$ metabolizing microorganism according to any of embodiments 36-38, wherein the exogenous nucleic acid encodes a threonine biosynthesis enzyme selected from the group consisting of an aspartate transaminase, a PLP-dependent aminotransferase, an aspartate aminotransferase, an aspartate kinase, an aspartate-semialdehyde dehydrogenase, a homoserine dehydrogenase, a homoserine kinase, and a threonine synthase.

48. The recombinant $C_1$ metabolizing microorganism of embodiment 47, wherein the L-amino acid is L-threonine.

49. The recombinant $C_1$ metabolizing microorganism according to any of embodiments 36-48, wherein the exogenous nucleic acid encodes an L-amino acid biosynthesis enzyme that is endogenous to a microorganism selected from the group consisting of *E. coli* and *C. glutamicum*.

50. The recombinant $C_1$ metabolizing microorganism according to any of embodiments 36-37, wherein the exogenous nucleic acid encodes an L-amino acid biosynthesis enzyme sequence selected from the group consisting of any one of SEQ ID NOs: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, and 150.

51. The recombinant $C_1$ metabolizing microorganism according to any of embodiments 36-50, wherein the sequence of the exogenous nucleic acid is codon optimized for optimal expression from the recombinant $C_1$ metabolizing microorganism.

52. The recombinant $C_1$ metabolizing microorganism of any of embodiments 36-51, wherein the exogenous nucleic acid encoding the L-amino acid biosynthesis enzyme is operatively linked to an expression control sequence.

53. The recombinant $C_1$ metabolizing microorganism of embodiment 52, wherein the expression control sequence is an exogenous expression control sequence.

54. The recombinant $C_1$ metabolizing microorganism of any of embodiments 36-53, wherein the $C_1$ metabolizing microorganism further comprises a deletion of an endogenous enzyme activity.

55. The recombinant $C_1$ metabolizing microorganism a according to any of embodiments 36-54, wherein the $C_1$ metabolizing microorganism is a methanotroph.

56. The recombinant $C_1$ metabolizing microorganism according to embodiment 55, wherein the methanotroph is *Methylomonas*, *Methylobacter*, *Methylococcus*, *Methylosinus*, *Methylocystis*, *Methylomicrobium*, *Methanomonas*, *Methylocella*, or *Methylocapsa*.

57. The recombinant $C_1$ metabolizing microorganism of embodiment 55, wherein the methanotroph is selected from the group consisting of *Methylococcus capsulatus* Bath strain, *Methylomonas methanica* 16a (ATCC PTA 2402), *Methylosinus trichosporium* OB3b (NRRL B-11,196), *Methylosinus sporium* (NRRL B-11,197), *Methylocystis parvus* (NRRL B-11,198), *Methylomonas methanica* (NRRL B-11,199), *Methylomonas albus* (NRRL B-11,200), *Methylobacter capsulatus* (NRRL B-11,201), *Methylobacterium organophilum* (ATCC 27,886), *Methylomonas* sp AJ-3670 (FERM P-2400), *Methylocella silvestris*, *Methylocella palustris* (ATCC 700799), *Methylocella tundrae*, *Methylocystis daltona* strain SB2, *Methylocystis bryophila*, *Methylocapsa aurea* KYG, *Methylacidiphilum infernorum*, *Methylibium petroleiphilum*, and *Methylomicrobium alcaliphilum*.

58. The recombinant $C_1$ metabolizing microorganism according to any one of embodiments 36-57, wherein the natural gas-derived carbon feedstock is selected from the group consisting of natural gas, syngas, methane, methanol, formaldehyde, formic acid, carbon monoxide, carbon dioxide, cyanide, a methylamine, a methylthiol, a methylhalogen, and any combination or two or more thereof.

59. The recombinant $C_1$ metabolizing microorganism of embodiment 58, wherein the natural gas-derived carbon feedstock is natural gas.

60. The recombinant $C_1$ metabolizing microorganism of embodiment 58, wherein the natural gas-derived carbon feedstock is methane.

61. The recombinant $C_1$ metabolizing microorganism of embodiment 58, wherein the natural gas-derived carbon feedstock is syngas.

62. The recombinant $C_1$ metabolizing microorganism of embodiment 61, wherein the $C_1$ metabolizing microorganism is a syngas metabolizing bacteria.

63. The recombinant $C_1$ metabolizing microorganism according to embodiment 62, wherein the syngas metabolizing bacteria is selected from the group consisting of *Clostridium autoethanogenum*, *Clostridium ljungdahli*, *Clostridium ragsdalei*, *Clostridium carboxydivorans*, *Butyribacterium methylotrophicum*, *Clostridium woodii*, and *Clostridium neopropanologen*.

64. The recombinant $C_1$ metabolizing microorganism according to any of embodiments 36-63, wherein the $\delta^{13}C$ of the biomass is less than −50‰.

65. A method of producing an L-amino acid, said method comprising culturing the recombinant $C_1$ metabolizing microorganism of any of embodiments 36-64 in the presence of a natural gas-derived carbon feedstock under conditions sufficient to produce the L-amino acid.

66. An L-amino acid produced by the method of embodiment 65, wherein the L-amino acid exhibits a $\delta^{13}C$ that is less than −40‰.

The foregoing and other aspects of the invention may be better understood in connection with the following non-limiting examples.

EXAMPLES

Example 1

Culture and Bioreactor Conditions for $C_1$ Metabolizing Microorganisms

Exemplary $C_1$ metabolizing microorganisms of the instant disclosure (methanotrophs, methylotrophs, clostridia) were cultured in tubes, in vials, in bottles, on plates, or in a bioreactor (fermentation). Growth conditions, media, and carbon source for various microorganisms are described in this example.

*Methylosinus trichosporium* Strain OB3b (NCIMB 11131); *Methylomonas* sp. Strain 16a (ATCC PTA-2402); or *Methylomonas methanica*

For serum bottles, the bacteria were cultured at 30° C. in Higgins minimal nitrate salts medium (NSM; Cornish et al., *J. Gen. Microbiol.* 130:2565, 1984; Park et al., *Biotechnol. Bioeng.* 38:423, 1991) or MM-W1 medium. The headspace composition was adjusted to a 1:1 volume of methane:air. The bottles were shaken at a rate of 200-250 rpm. Alternatively, the culture was maintained on NSM-media plates containing 1.5% w/v agar grown in a gas-tight chamber containing a 1:1 (v/v) methane:air gas mixture, or in the presence of methanol vapor (via 0.5 mL methanol in the lid of parafilm-sealed plates) or on NSM-media plates supplemented with 0.5% methanol. Plates were incubated inverted in a humidified chamber at 30° C.

The composition of the NSM medium used was as follows: 1.0 g $MgSO_4*7H_2O$, 0.20 g $CaCl_2*6H_2O$, 2.0 ml chelated iron solution (0.1 g ferric (III) ammonium citrate or 0.5 g ferric (III) chloride; 0.2 g EDTA, sodium salt; 0.3 ml HCl, concentrated; 100.0 ml distilled deionized $H_2O$), 1.0 g $KNO_3$, 0.5 ml trace element solution (500.0 mg EDTA, 200.0 mg $FeSO_4*7H_2O$, 10.0 mg $ZnSO_4*7H_2O$, 3.0 mg $MnCl_2*4H_2O$, 30.0 mg $H_3BO_3$, 20.0 mg $CoCl_2*6H_2O$, 1.0 mg $CaCl_2*2H_2O$, 2.0 mg $NiCl_2*6H_2O$, 3.0 mg $Na_2MoO_4*2H_2O$, 1.0 L distilled water), 0.272 g $KH_2PO_4$, 0.717 g $Na_2HPO_4*12H_2O$, optionally 12.5 g purified agar (e.g., Oxoid L28 or Bacto™ agar; used when making plates), 1.0 L distilled deionized water, pH adjusted to 6.8 and autoclaved at 121° C. for 15 minutes.

For fermentation, a 2-liter bioreactor containing 1 L of sterilized defined media MM-W1 was inoculated with cells from serum bottle batch cultures (10-20% v/v) grown in MM-W1 supplied with a 1:1 (v/v) mixture of methane and air. The composition of medium MM-W1 used was as follows: 0.8 mM $MgSO_4*7H_2O$, 10 mM $NaNO_3$, 0.14 mM $CaCl_2$, 1.2 mM $NaHCO_3$, 2.35 mM $KH_2PO_4$, 3.4 mM $K_2HPO_4$, 20.7 µM $Na_2MoO_4*2H_2O$, 1 µM $CuSO_4*5H_2O$, 10 µM $Fe^{III}$—Na-EDTA, and 1 mL per liter of trace metals solution (containing, per liter 500 mg $FeSO_4*7H_2O$, 400 mg $ZnSO_4*7H_2O$, 20 mg $MnCl_2*7H_2O$, 50 mg $CoCl_2*6H_2O$, 10 mg $NiCl_2*6H_2O$, 15 mg $H_3BO_3$, 250 mg EDTA). Phosphate, bicarbonate, and $Fe^{III}$—Na-EDTA were added after the media was autoclaved and cooled. Bicarbonate was added up to 0.1% (w/v) in certain fermentations. The reactor contents were stirred with an overhead impeller at a constant 750 rpm. The culture was fed with a constant methane sparging at about 60 mL/min to about 120 mL/min, while concentrated oxygen (at least 85%) was supplied at a variable rate of about 10-100 mL/min to maintain a dissolved oxygen level of about 40% to about 80% (relative to air saturation of the media).

Temperature in the bioreactor was maintained at 30° C. and pH was maintained at 7.1±0.1 using automated addition of 0.5M NaOH and 0.5M HCl, along with other additions, to the culture about every 4 hours to about 24 hours (corresponding to an $OD_{600}$ increase of approximately 5 OD units). The other additions alternated between a metal addition (10 µM CuSO4, 5 µM FeSO4, 5 µM $Fe^{III}$—Na-EDTA final concentrations) and a nutrient addition (5.75 mM KxHyPO4, 10 mM NaNO3). Under these conditions, essentially linear growth was observed, with an effective biomass generation rate of about 2.7 to about 3.3 grams dry cell weight per liter per day to an $OD_{600}$ of greater than 20. Culture biomass was harvested by centrifugation, washed once in MM-W1 media, and recovered biomass was either frozen at −80° C. or used immediately for fractionation of cellular components (e.g., lipid extraction).

A semi-continuous fermentation approach can also be applied to maintain biomass productivity and reduce time associated with fermentation shut-down and start-up (i.e., turn-around time or lead time).

Harvesting of the bacterial biomass was performed at approximately 12-24 hour intervals, as the culture density approached (but before entering) stationary phase. Approximately half of the bioreactor volume was removed by transferring to a separate container via centrifugal pump. An equal volume of sterilized or recycled media was then returned to the bioreactor such that the optical density of the reactor was approximately half of its initial value. The bioreactor fermentation was continued according to the above protocol so that multiple cycles of growth and biomass recovery could be carried out during a single fermentation run.

*Methylococcus capsulatus* Bath (NCIMB 11132)

The bacteria were cultured at 42° C. in serum bottles containing Higgins minimal nitrate salts medium (NSM) or MM-W1 medium. The headspace composition was adjusted to a 1:1 volume of methane:air. The bottles were shaken at a rate of 200-250 rpm. Alternatively, the culture was maintained on NSM-media plates solidified with 1.5% w/v agar grown in a gas-tight chamber containing a 1:1 (v/v) methane:air gas mixture. Plates were incubated inverted in the chamber at 42° C.

For fermentation, a 3-liter bioreactor containing 1.25 L sterilized media MMF1.1 was inoculated with cells from serum bottle batch cultures (10-20% v/v) grown in the same media supplied with a 1:1 (v/v) mixture of methane and air. The composition of medium MMF1.1 was as follows: 0.8 mM $MgSO_4*7H_2O$, 40 mM $NaNO_3$, 0.14 mM $CaCl_2$, 6 mM $NaHCO_3$, 4.7 mM $KH_2PO_4$, 6.8 mM $K_2HPO_4$, 20.7 µM $Na_2MoO_4*2H_2O$, 6 µM $CuSO_4*5H_2O$, 10 µM $Fe^{III}$—Na-EDTA, and 1 mL per liter of trace metals solution (containing, per liter 500 mg $FeSO_4*7H_2O$, 400 mg $ZnSO_4*7H_2O$, 20 mg $MnCl_2*7H_2O$, 50 mg $CoCl_2*6H_2O$, 10 mg $NiCl_2*6H_2O$, 15 mg $H_3BO_3$, 250 mg EDTA). Phosphate, bicarbonate, and $Fe^{III}$—Na-EDTA were added after media was autoclaved and cooled. The reactor contents were stirred with an overhead impeller at a constant 750 rpm. The culture was fed with a constant methane sparging at about 60 to about 200 mL/min, while concentrated oxygen (>85%) was supplied at a variable rate of 15-90 mL/min and the dissolved oxygen level was maintained below 10% (relative to air saturation of the media).

Temperature in the bioreactor was maintained at 44° C. and pH was maintained at 7.0±0.1 using automated addition of 0.5M NaOH and 0.5M HCl, along with additions of copper and iron (5 µM CuSO4, 5 µM $FeSO_4$, 10 µM $Fe^{III}$—Na-EDTA final concentration) to the culture every 3-6 hours (corresponding to an $OD_{600}$ increase of approximately 3-5 OD units after reaching OD 5). Under these conditions, essentially linear growth was observed, with effective biomass generation rate of more than 5 grams dry cell weight per liter per day to an $OD_{600}$ of greater than 10. Culture biomass was harvested by centrifugation, the cells washed once in MM-W1 media and cell pellets were either frozen at −80° C. or used immediately for fractionation of cellular components.

Nutrient depletion was recognized as an issue that could limit the growth yield during fermentation. To avoid limitation of nutrients, mainly nitrogen and phosphate, nutrient feeds composed of 2-fold concentrated MMF1.1 were initiated after culture $OD_{600}$ exceeded 5. The nutrient feed was initiated at dilution rates corresponding to approximately half of the cultures' growth rate to avoid wash-out and to maintain an increase in OD while expanding the culture volume. The bioreactor fermentation was continued according to the above protocol so that multiple cycles of growth and biomass recovery could be carried out during a single fermentation run.

*Methylobacterium extorquens* or *Methylosinus trichosporium* Strain OB3b (NCIMB 11131)

The bacteria is cultured at 30° C. in tubes containing Higgins minimal nitrate salts medium (NSM) supplemented with 0.5% methanol. The tubes are shaken at a rate of 200-250 rpm. Alternatively, the cultures are maintained on NSM-media plates containing 1.5% w/v agar grown in the presence of methanol vapor (via 0.5 mL methanol in the lid of parafilm-sealed plates) or supplemented with 0.5% methanol. Plates are incubated inverted in a humidified chamber under normal atmosphere at 30° C.

For fermentation, a 2-liter bioreactor containing 1 L defined media MM-W1 is inoculated with cells from culture tube batch culture (10-20% v/v). The composition of medium MM-W1 was as described above. The reactor contents are stirred with an overhead impeller at a constant 800 rpm. The culture is fed with an initial bolus of methanol to a final concentration of 0.5% and variable methanol feed, while pure oxygen was supplied at a variable rate of 30-100 mL/min to maintain a dissolved oxygen level of 60-90% (relative to air saturation of the media).

Temperature in the bioreactor was maintained at 30° C. and pH was maintained at 7.1±0.1 using automated addition of 0.5M NaOH and 1M HCl, along with the metal and nutrient additions as described above. Under these conditions, essentially linear growth is observed, with effective biomass generation rate 2.7 to 3.3 grams dry cell weight per liter per day to an $OD_{600}$ of greater than 20. Culture biomass was harvested by centrifugation, the cells washed once in MM-W1 media and cell pellets were either frozen at −80° C. or used immediately for fractionation of cellular components.

A semi-continuous fermentation approach can also be applied to maintain biomass productivity and reduce time associated with fermentation shut-down and start-up (i.e., turn-around time or lead time).

Harvesting of the accumulated bacterial biomass was performed at approximately 12-24 hour intervals, as the culture density approached (but before entering) stationary phase. Approximately half of the bioreactor volume was removed by transferring to a separate container via centrifugal pump. An equal volume of fresh or recycled media was then returned to the bioreactor such that the optical density of the reactor was approximately half of its initial value. The bioreactor fermentation was continued according to the above protocol so that multiple cycles of growth and biomass recovery was carried out during a single fermentation run.

*Clostridium autoethanogenum* and *Clostridium ljungdahlii*

The *Clostridium* bacteria are cultivated anaerobically in 100 mL modified PETC medium (ATCC medium 1754) at 37° C. in plastic-coated 500 ml-Schott Duran® GL45 bottles with butyl rubber stoppers and 200 kPa steel mill waste gas. Growth is monitored by measuring the optical density at 600 nm ($OD_{600}$).

The modified PETC medium contains (per liter) 1 g $NH_4Cl$, 0.4 g KCl, 0.2 g $MgSO_4*7H_2O$, 0.8 g NaCl, 0.1 g $KH_2PO_4$, 20 mg $CaCl_2*2 H_2O$, 10 ml trace elements solution (see below), 10 ml Wolfe's vitamin solution (see below), 2 g $NaHCO_3$, and 1 mg resazurin. After the pH is adjusted to 5.6, the medium is boiled, dispensed anaerobically, and autoclaved at 121° C. for 15 min. Steel mill waste gas (composition: 44% CO, 32% $N_2$, 22% $CO_2$, 2% $H_2$) or equivalent synthetic mixtures are used as a carbon source. The media has a final pH of 5.9 and is reduced with cysteine-HCl and $Na_2S$ at a concentration of 0.008% (w/v).

The trace elements solution contains 2 g nitrilotriacetic acid (adjusted to pH 6 with KOH before addition of the remaining ingredients), 1 g $MnSO_4$, 0.8 g $Fe(SO_4)_2(NH_4)_2*6H_2O$, 0.2 g $CoCl_2*6H_2O$, 0.2 mg $ZnSO_4*7H_2O$, 20 mg $CuCl_2*2 H_2O$, 20 mg $NiCl_2*6H_2O$, 20 mg $Na_2MoO_4*2H_2O$, 20 mg $Na_2SeO_4$, and 20 mg $Na_2WO_4$ per liter.

Wolfe's vitamin solution (Wolin et al., *J. Biol. Chem.* 238:2882, 1963) contains (per liter) 2 mg biotin, 2 mg folic acid, 10 mg pyridoxine hydrochloride, 5 mg thiamine-HCl, 5 mg riboflavin, 5 mg nicotinic acid, 5 mg calcium D-(+)-pantothenate, 0.1 mg vitamin B12, 5 mg p-aminobenzoic acid, and 5 mg thioctic acid.

a. *Clostridium autoethanogenum* Fermentation

Fermentation of *Clostridium autoethanogenum* is conducted using methods similar to those described in, for example, U.S. Patent Appl. No. 2011/0300593. Briefly, a 2-liter bioreactor containing 1.3 L Solution A (3.083 g $NH_4Ac$; 0.61 g $MgCl_2*6H_2O$; 0.294 g $CaCl_2*2H_2O$; 0.15 g KCl; 0.12 g NaCl (optional); up to 1 L with distilled water) is sparged with $N_2$ gas. An 85% solution of $H_3PO_4$ (2.025 mL, 30 mM) is added and the pH adjusted to 5.3 using concentrated, aqueous $NH_4OH$. Then 13.5 mL Solution B (20.0 mg Biotin; 20.0 mg Folic acid; 10.0 mg pyridoxine HCl; 50.0 mg thiamine*HCl; 50.0 mg Riboflavin; 50.0 mg nicotinic acid; 50.0 mg calcium D-(*)-pantothenate; 50.0 mg vitamin B12; 50.0 mg p-aminobenzoic acid; 50.0 mg thioctic acid; up to 1 L with distilled water) is added and the solution sparged with $N_2$ gas. Chromium (II) chloride is added until the oxidation-reduction potential (ORP) of the solution decreases to approximately −200 mV, wherein resazurin (1.35 mL of a 2 g/L solution) is added. Sodium polysulfide (5.4 mL of a 3M solution, see below) is added and the solution sparged with $N_2$ and then CO containing gas (1% $H_2$; 13% $N_2$; 71% CO; 15% $CO_2$). A metal sulfide solution (150 mL, see below) is added and the solution sparged a further 30 minutes, before inoculation with an actively growing *C. autoethanogenum* culture at a level of approximately 5% (v/v).

The sodium polysulfide solution is prepared in a 500 ml flask that is charged with $Na_2S$ (93.7 g, 0.39 mol) and 200 ml $H_2O$. The solution is stirred until the salt dissolves and sulfur (25 g, 0.1 mol) is added under constant $N_2$ flow. After stirring at room temperature for 2 hours, the sodium polysulfide solution (about 4 M with respect to Na and about 5 M with respect to sulfur), now a clear reddish brown liquid, is transferred into $N_2$ purged serum bottles, and wrapped in aluminum foil.

The chromium (II) solution is prepared in a 1 L three necked flask that is fitted with a gas tight inlet and outlet to allow working under inert gas and subsequent transfer of the desired product into a suitable storage flask. The flask is charged with $CrCl_3*6H_2O$ (40 g, 0.15 mol), zinc granules [20 mesh] (18.3 g, 0.28 mol), mercury (13.55 g, 1 mL, 0.0676 mol) and 500 mL distilled water. Following flushing with $N_2$ for one hour, the mixture is warmed to about 80° C. to initiate the reaction. Following two hours of stirring under a constant $N_2$ flow, the mixture is cooled to room temperature and continuously stirred for another 48 hours by which time the reaction mixture turns into a deep blue solution. The solution is transferred into $N_2$ purged serum bottles and stored at 4° C. for future use.

The metal sulfide solution is prepared by adding about 950 mL Solution A into a 1 L fermenter and sparging with $N_2$ gas. An 85% solution of $H_3PO_4$ (1.5 mL, 30 mM) is added and the pH adjusted to 5.3 using concentrated aqueous $NH_4OH$. Solution B (10 mL) is added and the solution sparged with $N_2$. Chromium (II) chloride is added until the oxidation-reduction potential (ORP) of the solution decreases to approximately −200 mV, wherein resazurin (1 mL of a 2 g/L solution) is added. Solution C (1/10; 10 ml $FeCl_3$; 5 ml $CoCl_2$; 5 ml $NiCl_2$; 1 ml $H_3BO_3$; 1 ml $Na_2MoO_4$; 1 ml $MnCl_2$; 1 ml $Na_2WO_4$; 1 ml $ZnCl_2$; 1 ml $Na_2SeO_3$; into 1 L media) is added, then sodium polysulfide (2 mL of a 3M solution) is added, and then the solution is sparged with $N_2$ gas.

Fermentation of a substrate comprising CO by *C. autoethanogenum* under batch conditions in the presence of polysulfide results in a substantially increased rate of accumulation and a final biomass accumulation of approximately 4 g/L over a 2-3 day period. For example, following a short lag phase of approximately 1 day, the biomass can increase from about 0.5 g/L up to at least 3.5 g/L over approximately 36 hours of fermentation. Furthermore, acetate is not produced during the growth phase in the presence of polysulfide (as is typically found in batch fermentations) and in certain circumstances some of the acetate is consumed, such that there is a net decrease in the amount of acetate in the fermenter. Culture biomass was harvested by centrifugation, the cells washed once in media and cell pellets were either frozen at −80° C. or used immediately for fractionation of cellular components.

A semi-continuous fermentation approach can also be applied to maintain biomass productivity and reduce time associated with fermentation shut-down and start-up (i.e., turn-around time or lead time).

Harvesting of the accumulated bacterial biomass was performed at approximately 12-24 hour intervals, as the culture density approached (but before entering) stationary phase. Approximately half of the bioreactor volume was removed by transferring to a separate container via centrifugal pump. An equal volume of fresh or recycled media was then returned to the bioreactor such that the optical density of the reactor was approximately half of its initial value. The bioreactor fermentation was continued according to the above protocol so that multiple cycles of growth and biomass recovery was carried out during a single fermentation run.

b. *Clostridium ljungdahlii* Fermentation

Fermentation of *Clostridium ljungdahlii* is performed using similar methods to those described in, for example, U.S. Pat. Nos. 5,173,429 and 5,593,886. Briefly, batch fermentations are conducted using a biologically pure culture of *C. ljungdahlii*. Preparation of the medium ((1) 80.0 mL of a salt comprising $KH_2PO_4$ 3.00 g/L, $K_2HPO_4$ 3.00 g/L, $(NH_4)_2SO_4$ 6.00 g/L, NaCl 6.00 g/L, $MgSO_4*2H_2O$ 1.25 g/L; (2) 1.0 g of yeast extract; (3) 1.0 g of trypticase; (4) 3.0 ml of PFN (Pfenning) trace metal solution comprising $FeCl_2*4H_2O$ 1500 mg, $ZnSO_4*7H_2O$ 100 mg, $MnCl_2*4H_2O$ 30 mg, $H_3BO_3$ 300 mg, $CoCl_2*6H_2O$ 200 mg, $CuCl_2*H_2O$ 10 mg, $NiCl_2*6H_2O$ 20 mg, $NaMoO_4*2H_2O$ 30 mg, $Na_2SeO_3$ 10 mg, and distilled water up to 1 L; (5) 10.0 ml of B vitamins comprising Pyridoxal HCl 10 mg, Riboflavin 50 mg, Thiamine HCl 50 mg, Nictotinic acid 50 mg, Ca-D-Pantotheinate 50 mg, Lipoic acid 60 mg, p-aminobenzoic acid 50 mg, Folic acid 20 mg, Biotin 20 mg, cyanocobalamin 50 mg, and distilled water up to 1 L; (6) 0.5 g of cysteine HCl; (7) 0.06 g $CaCl_2*2H_2O$; (8) 2.0 g $NaHCO_3$; (9) 1.0 mL resazurin (0.01%); and (10) 920.0 mL distilled water) is carried out anaerobically in an atmosphere of 80% nitrogen and 20% $CO_2$. The pH of the medium is controlled during fermentation and maintained at 5.0 with HCl. If required, adjustments to the pH are made with sterile 10% NaOH or 1.0% acetic acid solution. The medium is transferred to 157.5 mL serum bottles and sealed with butyl rubber stoppers and aluminum seals. The bottles are then autoclaved at 121° C. for 20 minutes.

Approximately 48 hours before commencing the experiment, a seed culture is prepared from a stock culture of the *C. ljungdahlii* in a bottle similar to those as described above. The seed culture is grown in a shaker incubator at 37° C. and shaken at 100 rpm. Reducing solutions (2.0 ml $Na_2S$, 2.5% solution and 2.0 ml cysteine-HCl, 3.5% solution) are added to the culture, which is placed in the shaker incubator for approximately 15 minutes to allow for complete oxygen removal and temperature acclimation. Unlike the procedure used for isolating a biologically pure culture of the organism, addition of methane inhibitors is not required in batch fermentations.

Fermentation with *C. ljungdahlii* is performed in a New Brunswick Scientific Bioflow IIc 2.5-liter fermenter containing nutrient media at 37° C., and a constant fluid level of 1.5 liters is maintained while the fluid is agitated at variable rates of up to 1,000 revolutions per minute with gas introduced at a rate of approximately 500 cubic centimeters per minute. Optimal gas retention times are in the range of three minutes. The gas feed is varied with its uptake by the bacteria, which is in turn a function of the cell density.

Harvesting of the accumulated bacterial biomass was performed at approximately 12-24 hour intervals, as the culture density approached (but before entering) stationary phase. Approximately half of the bioreactor volume was removed by transferring to a separate container via centrifugal pump. An equal volume of fresh or recycled media was then returned to the bioreactor such that the optical density of the reactor was approximately half of its initial value. The bioreactor fermentation was continued according to the above protocol so that multiple cycles of growth and biomass recovery was carried out during a single fermentation run.

Example 2

Stable Carbon Isotope Distribution in Lipids from $C_1$ Metabolizing Microorganisms Dry samples of *M. trichosporium* biomass and lipid fractions were analyzed for carbon and nitrogen content (% dry weight), and carbon ($^{13}C$) and nitrogen ($^{15}N$) stable isotope ratios via elemental analyzer/continuous flow isotope ratio mass spectrometry using a CHNOS Elemental Analyzer (vario ISOTOPE cube, Elementar, Hanau, Germany) coupled with an IsoPrime100 IRMS (Isoprime, Cheadle, UK). Samples of methanotrophic biomass cultured in fermenters or serum bottles were centrifuged, resuspended in deionized water and volumes corresponding to 0.2-2 mg carbon (about 0.5-5 mg dry cell weight) were transferred to 5×9 mm tin capsules (Costech Analytical Technologies, Inc., Valencia, Calif.) and dried at 80° C. for 24 hours. Similarly, previously extracted lipid fractions were suspended in chloroform and volumes containing 0.1-1.5 mg carbon were transferred to tin capsules and evaporated to dryness at 80° C. for 24 hours. Standards containing 0.1 mg carbon provided reliable $\delta^{13}C$ values.

The isotope ratio is expressed in "delta" notation (‰), wherein the isotopic composition of a material relative to that of a standard on a per million deviation basis is given by $\delta^{13}C$ (or $\delta^{15}N$)=($R_{sample}/R_{standard-1}$)×1,000, wherein R is the molecular ratio of heavy to light isotope forms. The standard for carbon is the Vienna Pee Dee Belemnite (V-PDB) and for nitrogen is air. The NIST (National Institute of Standards and Technology) proposed SRM (Standard Reference Material) No. 1547, peach leaves, was used as a calibration standard. All isotope analyses were conducted at the Center for Stable Isotope Biogeochemistry at the University of California, Berkeley. Long-term external precision for C and N isotope analyses is 0.10‰ and 0.15‰, respectively.

*M. trichosporium* strain OB3b was grown on methane in three different fermentation batches, *M. capsulatus* Bath was grown on methane in two different fermentation batches, and *Methylomonas* sp. 16a was grown on methane in a single fermentation batch. The biomass from each of these cultures was analyzed for stable carbon isotope distribution ($\delta^{13}C$ values; see Table 1).

TABLE 1

Stable Carbon Isotope Distribution in Different Methanotrophs

| Methanotroph | Batch No. | EFT (h)† | $OD_{600}$ | DCW* | $\delta^{13}C$ Cells |
|---|---|---|---|---|---|
| Mt OB3b | 68A | 48 | 1.80 | 1.00 | −57.9 |
|  |  | 64 | 1.97 | 1.10 | −57.8 |
|  |  | 71 | 2.10 | 1.17 | −58.0 |
|  |  | 88 | 3.10 | 1.73 | −58.1 |
|  |  | 97 | 4.30 | 2.40 | −57.8 |
|  |  | 113 | 6.00 | 3.35 | −57.0 |
|  |  | 127 | 8.40 | 4.69 | −56.3 |
| Mt OB3b | 68B | 32 | 2.90 | 1.62 | −58.3 |
|  |  | 41 | 4.60 | 2.57 | −58.4 |

TABLE 1-continued

Stable Carbon Isotope Distribution in Different Methanotrophs

| Methanotroph | Batch No. | EFT (h)† | $OD_{600}$ | DCW* | $\delta^{13}C$ Cells |
|---|---|---|---|---|---|
|  |  | 47 | 5.89 | 3.29 | −58.0 |
|  |  | 56 | 7.90 | 4.41 | −57.5 |
| Mt OB3b | 68C | 72 | 5.32 | 2.97 | −57.9 |
|  |  | 79.5 | 5.90 | 3.29 | −58.0 |
|  |  | 88 | 5.60 | 3.12 | −57.8 |
|  |  | 94 | 5.62 | 3.14 | −57.7 |
| Mc Bath | 62B | 10 | 2.47 | 0.88 | −59.9 |
|  |  | 17.5 | 5.80 | 2.06 | −61.0 |
|  |  | 20 | 7.32 | 2.60 | −61.1 |
|  |  | 23 | 9.34 | 3.32 | −60.8 |
|  |  | 26 | 10.30 | 3.66 | −60.1 |
| Mc Bath | 62A | 10 | 2.95 | 1.05 | −55.9 |
|  |  | 13.5 | 3.59 | 1.27 | −56.8 |
|  |  | 17.5 | 5.40 | 1.92 | −55.2 |
|  |  | 23 | 6.08 | 2.16 | −57.2 |
|  |  | 26 | 6.26 | 2.22 | −57.6 |
| Mms 16a | 66B | 16 | 2.13 | 0.89 | −65.5 |
|  |  | 18 | 2.59 | 1.09 | −65.1 |
|  |  | 20.3 | 3.62 | 1.52 | −65.5 |
|  |  | 27 | 5.50 | 2.31 | −66.2 |
|  |  | 40.5 | 9.80 | 4.12 | −66.3 |

*DCW, Dry Cell Weight is reported in g/L calculated from the measured optical densities ($OD_{600}$) using specific correlation factors relating OD of 1.0 to 0.558 g/L for Mt OB3b, OD of 1.0 to 0.355 g/L for Mc Bath, and OD of 1.0 to 0.42 g/L for Mms 16a. For Mt OB3b, the initial concentration of bicarbonate used per fermentation was 1.2 mM or 0.01% (Batch No. 68C) and 0.1% or 12 mM (Batch Nos. 68A and 68B).
†EFT = effective fermentation time in hours In addition, stable carbon isotope analysis was performed for biomass and corresponding lipid fractions (see Table 2) from strains *Methylosinus trichosporium* OB3b (Mt OB3b), *Methylococcus capsulatus* Bath (Mc Bath), and *Methylomonas* sp. 16a (Mms 16a) grown on methane in bioreactors as described in Example 1.

TABLE 2

Stable Carbon Isotope Distribution in Cells and Lipids

| Batch No. | Strain | $\delta^{13}C$ Cells | $\delta^{13}C$ Lipids |
|---|---|---|---|
| 68C | Mt OB3b | −57.7 | −48.6 |
| 62A | Mc Bath | −57.6 | −52.8 |
| 66A | Mms 16a | −64.4 | −42.2 |

Biomass from strains Mt OB3b, Mc Bath and Mms 16a were harvested at 94 h (3.14 g DCW/L), 26 h (2.2 g DCW/L) and 39 h (1.14 g DCW/L), respectively. The $\delta^{13}C$ values for lipids in Table 4 represent an average of duplicate determinations.

Example 3

Effect of Methane Source and Purity on Stable Carbon Isotope Distribution in Lipids To examine methanotroph growth on methane containing natural gas components, a series of 0.5-liter serum bottles containing 100 mL defined media MMS1.0 were inoculated with *Methylosinus trichosporium* OB3b or *Methylococcus capsulatus* Bath from a serum bottle batch culture (5% v/v) grown in the same media supplied with a 1:1 (v/v) mixture of methane and air. The composition of medium MMS1.0 was as follows: 0.8 mM $MgSO_4*7H_2O$, 30 mM $NaNO_3$, 0.14 mM $CaCl_2$, 1.2 mM $NaHCO_3$, 2.35 mM $KH_2PO_4$, 3.4 mM $K_2HPO_4$, 20.7 µM $Na_2MoO_4*2H_2O$, 6 µM $CuSO_4*5H_2O$, 10 µM $Fe^{III}$—Na-EDTA, and 1 mL per liter of a trace metals solution (containing, per L: 500 mg $FeSO4.7H_2O$, 400 mg $ZnSO_4*7H_2O$, 20 mg $MnCl_2*7H2O$, 50 mg $CoCl_2*6H_2O$, 10 mg $NiCl_2*6H_2O$, 15 mg $H_3BO_3$, 250 mg EDTA). Phosphate, bicarbonate, and $Fe^{III}$—Na-EDTA were added after media was autoclaved and cooled. The final pH of the media was 7.0±0.1.

The inoculated bottles were sealed with rubber sleeve stoppers and injected with 60 mL methane gas added via syringe through sterile 0.45 µm filter and sterile 27G needles. Duplicate cultures were each injected with 60 mL volumes of (A) methane of 99% purity (grade 2.0, Praxair through Alliance Gas, San Carlos, Calif.), (B) methane of 70% purity representing a natural gas standard (Sigma-Aldrich; also containing 9% ethane, 6% propane, 3% methylpropane, 3% butane, and other minor hydrocarbon components), (C) methane of 85% purity delivered as a 1:1 mixture of methane sources A and B; and (D) >93% methane (grade 1.3, Specialty Chemical Products, South Houston, Tex.; in-house analysis showed composition >99% methane). The cultures were incubated at 30° C. (M. trichosporium strain OB3b) or 42° C. (M. capsulatus Bath) with rotary shaking at 250 rpm and growth was measured at approximately 12 hour intervals by withdrawing 1 mL samples to determine $OD_{600}$. At these times, the bottles were vented and headspace replaced with 60 mL of the respective methane source (A, B, C, or D) and 60 mL of concentrated oxygen (at least 85% purity). At about 24 hour intervals, 5 mL samples were removed, cells recovered by centrifugation (8,000 rpm, 10 minutes), and then stored at −80° C. before analysis.

Analysis of carbon and nitrogen content (% dry weight), and carbon ($^{13}C$) and nitrogen ($^{15}N$) stable isotope ratios, for methanotrophic biomass derived from M. trichosporium strain OB3b and M. capsulatus Bath were carried out. Table 3 shows the results of stable carbon isotope analysis for biomass samples from M. capsulatus Bath grown on methane having different levels of purity and in various batches of bottle cultures.

TABLE 3

Stable Carbon Isotope Distribution of M. capsulatus Bath Grown on Different Methane Sources having Different Purity

| Methane* | Batch No. | Time (h)† | $OD_{600}$ | DCW (g/L) | $\delta^{13}C$ Cells |
|---|---|---|---|---|---|
| A | 62C | 22 | 1.02 | 0.36 | −40.3 |
|   |     | 56 | 2.01 | 0.71 | −41.7 |
|   |     | 73 | 2.31 | 0.82 | −42.5 |
|   | 62D | 22 | 1.14 | 0.40 | −39.3 |
|   |     | 56 | 2.07 | 0.73 | −41.6 |
|   |     | 73 | 2.39 | 0.85 | −42.0 |
| B | 62E | 22 | 0.47 | 0.17 | −44.7 |
|   |     | 56 | 0.49 | 0.17 | −45.4 |
|   |     | 73 | 0.29 | 0.10 | −45.4 |
|   | 62F | 22 | 0.62 | 0.22 | −42.3 |
|   |     | 56 | 0.63 | 0.22 | −43.6 |
|   |     | 73 | 0.30 | 0.11 | −43.7 |
| C | 62G | 22 | 0.70 | 0.25 | −40.7 |
|   |     | 56 | 1.14 | 0.40 | −44.8 |
|   |     | 73 | 1.36 | 0.48 | −45.8 |
|   | 62H | 22 | 0.62 | 0.22 | −40.9 |
|   |     | 56 | 1.03 | 0.37 | −44.7 |
|   |     | 73 | 1.23 | 0.44 | −45.9 |

*Methane purity: A: 99% methane, grade 2.0 (min. 99%); B: 70% methane, natural gas standard (contains 9% ethane, 6% propane, 3% methylpropane, 3% butane); C: 85% methane (1:1 mix of A and B methane)
†Time = bottle culture time in hours The average $\delta^{13}C$ for M. capsulatus Bath grown on one source of methane (A, 99%) was −41.2±1.2, while the average $\delta^{13}C$ for M. capsulatus Bath grown on a different source of methane (B, 70%) was −44.2±1.2. When methane sources A and B were mixed, an intermediate average $\delta^{13}C$ of −43.8±2.4 was observed. These data show that the $\delta^{13}C$ of cell material grown on methane sources A and B are significantly different from each other due to the differences in the $\delta^{13}C$ of the input methane. But, cells grown on a mixture of the two gasses preferentially utilize $^{12}C$ and, therefore, show a trend to more negative $\delta^{13}C$ values.

A similar experiment was performed to examine whether two different methanotrophs, Methylococcus capsulatus Bath and Methylosinus trichosporium OB3b, grown on different methane sources and in various batches of bottle cultures showed a difference in $\delta^{13}C$ distribution (see Table 4).

TABLE 4

Stable Carbon Isotope Distribution of Different Methanotrophs Grown on Different Methane Sources of Different Purity

| Strain | Methane* | Batch No. | Time (h)† | $OD_{600}$ | DCW (g/L) | $\delta^{13}C$ Cells |
|---|---|---|---|---|---|---|
| Mc Bath | A | 62I | 18 | 0.494 | 0.18 | −54.3 |
|         |   |     | 40 | 2.33  | 0.83 | −42.1 |
|         |   |     | 48 | 3.08  | 1.09 | −37.1 |
| Mc Bath | D | 62J | 18 | 0.592 | 0.21 | −38.3 |
|         |   |     | 40 | 1.93  | 0.69 | −37.8 |
|         |   |     | 48 | 2.5   | 0.89 | −37.8 |
| Mc Bath | D | 62K | 18 | 0.564 | 0.20 | −38.6 |
|         |   |     | 40 | 1.53  | 0.54 | −37.5 |
|         |   |     | 48 | 2.19  | 0.78 | −37.6 |
| Mt OB3b | A | 68D | 118 | 0.422 | 0.24 | −50.2 |
|         |   |     | 137 | 0.99  | 0.55 | −47.7 |
|         |   |     | 162 | 1.43  | 0.80 | −45.9 |
| Mt OB3b | A | 68E | 118 | 0.474 | 0.26 | −49.9 |
|         |   |     | 137 | 1.065 | 0.59 | −47.6 |
|         |   |     | 162 | 1.51  | 0.84 | −45.2 |
| Mt OB3b | D | 68F | 118 | 0.534 | 0.30 | −45.6 |
|         |   |     | 137 | 1.119 | 0.62 | −38.7 |
|         |   |     | 162 | 1.63  | 0.91 | −36.4 |
| Mt OB3b | D | 68G | 118 | 0.544 | 0.30 | −44.8 |
|         |   |     | 137 | 1.131 | 0.63 | −39.1 |
|         |   |     | 162 | 1.6   | 0.89 | −34.2 |

*Methane sources and purity: A: 99% methane (grade 2.0); D: >93% methane (grade 1.3)
†Time = bottle culture time in hours The average $\delta^{13}C$ for M. capsulatus grown on a first methane source (A) was −44.5±8.8, while the average $\delta^{13}C$ for M. trichosporium was −47.8±2.0 grown on the same methane source. The average $\delta^{13}C$ for M. capsulatus grown on the second methane source (B) was −37.9±0.4, while the average $\delta^{13}C$ for M. trichosporium was −39.8±4.5. These data show that the $\delta^{13}C$ of cell material grown on a methane source is highly similar to the $\delta^{13}C$ of cell material from a different strain grown on the same source of methane. Thus, the observed $\delta^{13}C$ of cell material appears to be primarily dependent on the composition of the input gas rather than a property of a particular bacterial strain being studied.

Example 4

Cloning and Expression of Individual or Two Genes from the L-Lysine Biosynthesis Operon in Methanococcus capsulatus Bath Strain To create a methanotrophic bacterial strain that overproduces the amino acid L-lysine, a methanotroph expression vector containing a gene encoding the amino acid sequence of the enzyme dihydrodipicolinate synthase (dapA) (SEQ ID NO 121) or diaminopimelate decarboxylase (lysA) (SEQ ID NO: 123) and diaminopimelate epimerase (dapF) (SEQ ID NO:125) or succinyldiaminopimelate desuccinylase (dapE) (SEQ ID NO: 127) or aspartate semialdehyde dehydrogenase (asd) (SEQ ID NO: 129) or dihydropicolinate reductase (dapB) (SEQ ID NO:131) or acetylornithine aminotransferase (argD) (SEQ ID NO:133) was introduced into *Methylococcus capsulatus* Bath via conjugative mating. The enzymes are native to *Methylococcus capsulatus* Bath. An episomal expression plasmid (containing sequences encoding origin of replication, origin of transfer, drug resistance marker (kanamycin), and multiple cloning sites), was used to clone each of these polynucleotide sequence downstream of an engineered IPTG-inducible (LacI$^q$) methanol dehydrogenase (MDH) promoter. Colonies of conjugation-competent *E. coli* strain (S-17) harboring either the pathway gene-containing plasmid, an unrelated gene in the same expression system, or a plasmid without the described promoter construct (donor strains) were inoculated in liquid LB containing Kanamycin (30 μg/mL) and grown at 37° C. overnight. One part of the liquid donor culture was inoculated into 100 parts of fresh LB containing Kanamycin (30 μg/mL) for 3-5 h before they were used to mate with the recipient methanotrophic strains. Methanotrophic (recipient) strain was inoculated in liquid MM-W1 medium (Pieja et al., *Microbial Ecology* 62:564-573, 2011) with about 40 mL methane for 1-2 days prior to mating until they reached logarithmic growth phase ($OD_{600}$ of about 0.3).

Biparental mating was conducted by preparing the recipient and donor strains at a volume so that the $OD_{600}$ ratio was 1:1 (e.g., 1 mL of methanotroph with an $OD_{600}$ of 1.5 and 1 mL of donor with an $OD_{600}$ of 1.5). These cells were then harvested by centrifugation for 60 s at 13.2 k rpm. The supernatant was removed, and the cell pellets were gently resuspended in 500 μL MM-W1. For the *E. coli* donor strain, centrifugation and resuspension was repeated 2 more times to ensure the removal of antibiotics. Equal volumes of the resuspended cells of recipient and donor strains were then combined and mixed by gentle pipetting. The mating composition was centrifuged for 60 s at 13.2 k rpm, and the supernatant was removed as much as possible. The cell pellet was then gently mixed and deposited as a single droplet onto mating agar (complete MM-W1 medium containing sterile 0.5% yeast extract). The mating plates were incubated for 48 h in a sealed chamber containing methane and air (at a 1:1 ratio) at 37° C. After the 48 h incubation period, the cells from the mating plates were collected by adding 1 mL MM-W1 medium onto the plates and transferring the suspended cells to a 2 mL Eppendorf tube. The cells were pelleted by centrifugation and resuspended with 100 μL fresh MM-W1 before plating onto selection plates (complete MM-W1 agar medium containing kanamycin 7.5 μg/mL) to select for cells that stably maintain the constructs. Plasmid-bearing methanotrophs appeared on these plates after about 1 week of incubation at 42° C. Colonies were then grown in a shaking incubator at 42° C. in 2.5 ml liquid media (MMS1) in sealed vessels containing 1:1 methane to air ratio. After 24 hours, IPTG was added to a final concentration of 5 mM to induce expression of the target gene. After 72 additional hours, the cultures were assayed for amino acid production using the method described in Example 9. Table 5 provides a summary description of the strains.

TABLE 5

Summary of Strains

| Genotype ID | Incorporated Nucleic Acid SEQ ID NO. | Nucleic Acid Name |
|---|---|---|
| 34 | Empty pMS3 control | Empty pMS3 control |
| 1057 | 121 | dapA |
| 1058 | 123, 125 | lysA, dapF |
| 1060 | 127 | dapE |
| 1061 | 129 | Asd |
| 1062 | 131 | dapB |
| 1063 | 133 | argD |
| 1067 | Green fluorescent reporter gene | Green fluorescent reporter gene |

The results are presented in FIG. 1, which is a graph of extracellular L-lysine concentration (as detected in the cell supernatant of strains heterologously expressing the indicated gene) divided by the optical density ($OD_{600}$) of the culture as a function of the strain. Genotype keys 34 and 1067 are empty plasmid control and a control expressing an unrelated gene (encoding a green fluorescent protein) in the same promoter context. The bars represent the average of between one and eight samples (some clones did not grow). The graph indicates that overexpression of the indicated genes results in an increase in extracellular L-lysine of between 10 and 16 fold over empty plasmid control (genotype key 34) and between 1.2 and 2.1 fold over unrelated gene control (genotype key 1067). The results demonstrate the increased production of extracellular L-lysine as a result of expression of the L-amino acid biosynthesis enzyme-encoding nucleic acid indicated, which were under the control of an exogenous promoter.

Example 5

Cloning and Expression of a Gene Coding for a Protein with High L-Lysine Content (Cache Protein) in *Methanococcus capsulatus* Bath Strain To create a methanotrophic bacterial strain that overproduces the amino acid L-lysine in cell-associated biomass, a methanotroph expression vector containing one of several gene variants coding for the amino acid sequence of a protein with elevated L-lysine content (an S9A family peptidase designated here as HighK (SEQ ID NO:152)) was introduced into *Methylococcus capsulatus* Bath via conjugative mating. An episomal expression plasmid (containing sequences encoding origin of replication, origin of transfer, drug resistance marker (kanamycin), and multiple cloning sites), was used to clone the HighK polynucleotide sequences (SEQ ID NOS.:151, 153, 155, 157, 159, 161, 163, and 165, each a different codon optimized sequence for *Methylococcus capsulatus* Bath) downstream of an engineered IPTG-inducible (Laclq) methanol dehydrogenase (MDH) promoter. Colonies of conjugation-competent *E. coli* strain (S-17) harboring either the experimental gene-containing plasmid or a "negative control" plasmid without the described promoter-gene construct (donor strains) were inoculated in liquid LB containing Kanamycin (30 μg/mL) and grown at 37° C. overnight. One part of the liquid donor culture was inoculated into 100 parts of fresh LB containing Kanamycin (30 μg/mL) for 3-5 h before they were used to mate with the recipient methanotrophic strains. Methanotrophic (recipient) strain was inoculated in liquid MM-W1 medium (Pieja et al., *Microbial Ecology* 62:564-573, 2011) with about 40 mL methane for 1-2 days prior to mating until they reached logarithmic growth phase ($OD_{600}$ of about 0.3).

Biparental mating was conducted by preparing the recipient and donor strains at a volume so that the $OD_{600}$ ratio was 1:1 (e.g., 5 mL of methanotroph with an $OD_{600}$ of 0.3 and 5 mL of donor with an $OD_{600}$ of 0.3). These cells were then harvested by centrifugation for 60s at 13.2 k rpm. The supernatant was removed, and the cell pellets were gently resuspended in 500 µL MM-W1. For the *E. coli* donor strain, centrifugation and resuspension was repeated 2 more times to ensure the removal of antibiotics. Equal volumes of the resuspended cells of recipient and donor strains were then combined and mixed by gentle pipetting. The mating composition was centrifuged for 60 s at 13.2 k rpm, and the supernatant was removed as much as possible. The cell pellet was then gently mixed and deposited as a single droplet onto mating agar (complete MM-W1 medium containing sterile 0.5% yeast extract). The mating plates were incubated for 48 h in a sealed chamber containing methane and air (at a 1:1 ratio) at 37° C. After the 48 h incubation period, the cells from the mating plates were collected by adding 1 mL MM-W1 medium onto the plates and transferring the suspended cells to a 2 mL Eppendorf tube. The cells were pelleted by centrifugation and resuspended with 100 µL fresh MM-W1 before plating onto selection plates (complete MM-W1 agar medium containing kanamycin 7.5 µg/mL) to select for cells that stably maintain the constructs. Plasmid-bearing methanotrophs appeared on these plates after about 1 week of incubation at 42° C. Colonies were then grown in a shaking incubator at 42° C. in 2.5 ml liquid media (MMS1) in sealed vessels containing 1:1 methane to air ratio. After 24 hours, IPTG was added to a final concentration of 5 mM to induce expression of the target gene. After a designated time period (either 48 or 72 additional hours, depending on culturing conditions), the cultures were assayed for amino acid production using the method described in Example 9. Table 6 provides a summary description of the strains.

TABLE 6

Summary of Strains

| Genotype ID | Incorporated Nucleic Acid SEQ ID NO: | Nucleic Acid Name |
|---|---|---|
| 34 | Empty pMS3 control | Empty pMS3 control |
| 1115 | 151 | HighK |
| 1116 | 153 | HighK |
| 1117 | 155 | HighK |
| 1118 | 157 | HighK |
| 1119 | 159 | HighK |
| 1120 | 161 | HighK |
| 1121 | 163 | HighK |
| 1122 | 165 | HighK |

Figure 2:
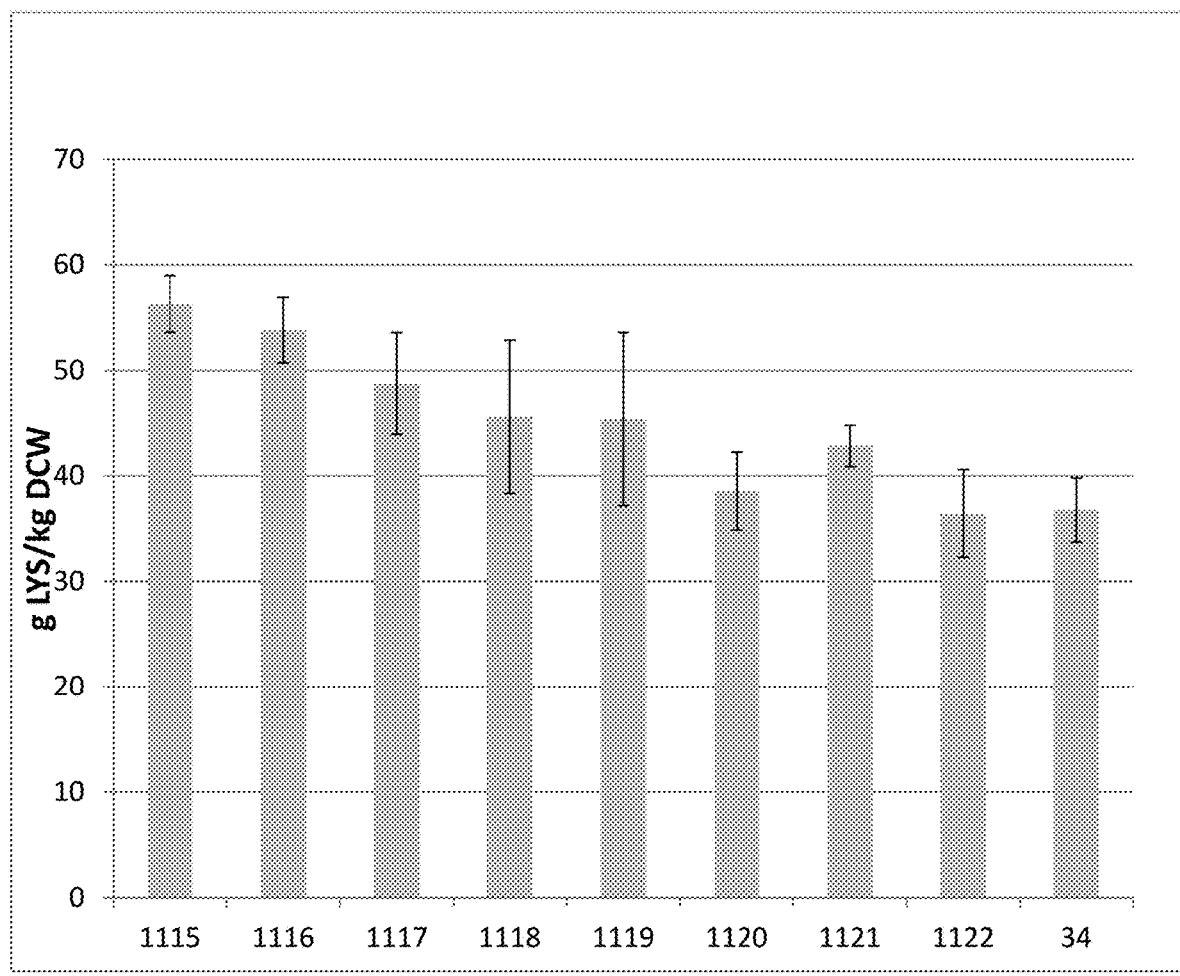
FIG. 2 provides a graphical depiction of the concentration of cell-associated L-lysine detected in cell biomass samples of strains heterologously expressing different codon optimized sequences that each encode the same cache protein (a high lysine content polypeptide), as described in Example 5. Genotype key 34 is an empty plasmid control. The bars represent the averaged values of eight clones in each experimental genotype.

The concentration of cell-associated L-lysine detected in cell biomass samples of strains heterologously expressly the indicated genes is depicted in FIG. 2. Genotype key 34 is an empty plasmid control. The bars represent the averaged values of eight clones in each experimental genotype. All of the genes encoded the same S9A family peptidase (HighK) protein, but each has a different sequence that corresponds to varying codon usages. The graph indicates that expression of the indicated genes results in a range of cell-associate L-lysine content. Genotype key 1122 show no increase in this value relative to the control (34), whereas genotype key 1115 shows an increase of 53% over the control.

Example 6

Cloning and Co-Expression of Dihydropicolinate Synthase and a Cache Protein in *Methanococcus capsulatus* Bath To create a methanotrophic bacterial strain that overproduces the amino acid L-lysine, a methanotroph expression vector containing a gene encoding the amino acid sequence of the enzyme dihydrodipicolinate synthase (dapA) (SEQ ID NO:121) and one of several gene variants coding for the amino acid sequence of a protein with elevated lysine content (an S9A family peptidase designated here as HighK (SEQ ID NO:152)) was introduced into *Methylococcus capsulatus* Bath via conjugative mating. An episomal expression plasmid (containing sequences encoding origin of replication, origin of transfer, drug resistance marker (kanamycin), and multiple cloning sites), was used to clone the dapA (SEQ ID NO:121) and the HighK polynucleotide sequences (SEQ ID NOs:151, 153, 155, 157, 159, 161, 163, and 165, each a different codon optimized sequence for *Methylococcus capsulatus* Bath) for *Methylococcus capsulatus* Bath) downstream of an engineered IPTG-inducible (LacIq) methanol dehydrogenase (MDH) promoter. Colonies of conjugation-competent *E. coli* strains (S-17) harboring either the experimental genes-containing plasmid or a "negative control" plasmid without the described promoter-genes construct (donor strains) were inoculated in liquid LB containing Kanamycin (30 µg/mL) and grown at 37° C. overnight. One part of the liquid donor culture was inoculated into 100 parts of fresh LB containing Kanamycin (30 µg/mL) for 3-5 h before they were used to mate with the recipient methanotrophic strains. Methanotrophic (recipient) strain was inoculated in liquid MM-W1 medium (Pieja et al., *Microbial Ecology* 62:564-573, 2011) with about 40 mL methane for 1-2 days prior to mating until they reached logarithmic growth phase ($OD_{600}$ of about 0.3).

Biparental mating was conducted by preparing the recipient and donor strains at a volume so that the $OD_{600}$ ratio was 1:1 (e.g., 5 mL of methanotroph with an $OD_{600}$ of 0.3 and 5 mL of donor with an $OD_{600}$ of 0.3). These cells were then harvested by centrifugation for 60 s at 13.2 k rpm. The supernatant was removed, and the cell pellets were gently resuspended in 500 µL MM-W1. For the *E. coli* donor strain, centrifugation and resuspension was repeated 2 more times to ensure the removal of antibiotics. Equal volumes of the resuspended cells of recipient and donor strains were then combined and mixed by gentle pipetting. The mating composition was centrifuged for 60 s at 13.2 k rpm, and the supernatant was removed as much as possible. The cell pellet was then gently mixed and deposited as a single droplet onto mating agar (complete MM-W1 medium containing sterile 0.5% yeast extract). The mating plates were incubated for 48 h in a sealed chamber containing methane and air (at a 1:1 ratio) at 37° C. After the 48 h incubation period, the cells from the mating plates were collected by adding 1 mL MM-W1 medium onto the plates and transferring the suspended cells to a 2 mL Eppendorf tube. The cells were pelleted by centrifugation and resuspended with 100 µL fresh MM-W1 before plating onto selection plates (complete MM-W1 agar medium containing kanamycin 7.5 µg/mL) to select for cells that stably maintain the constructs. Plasmid-bearing methanotrophs appeared on these plates after about 1 week of incubation at 42° C. Colonies were then grown in a shaking incubator at 42° C. in 2.5 ml liquid media (MMS1) in sealed vessels containing 1:1 methane to air ratio. After 24 hours, IPTG was added to a final concentration of 5 mM to induce expression of the target gene. After a designated time period (either 48 or 72 additional hours, depending on culturing conditions), the cultures were assayed for amino acid production. Table 7 provides a summary description of the strains.

TABLE 7

Summary of Strains

| Genotype ID | Incorporated Nucleic Acid SEQ ID NO: | Nucleic Acid Name |
| --- | --- | --- |
| 1067 | Green fluorescent reporter gene | Green fluorescent reporter gene |
| 1186 | 151, 121 | HighK, dapA |
| 1187 | 153, 121 | HighK, dapA |
| 1188 | 155, 121 | HighK, dapA |
| 1189 | 157, 121 | HighK, dapA |
| 1190 | 159, 121 | HighK, dapA |
| 1191 | 161, 121 | HighK, dapA |
| 1192 | 163, 121 | HighK, dapA |
| 1193 | 165, 121 | HighK, dapA |

The results are described in Table 8 below and FIGS. 3 and 4, as described below.

TABLE 8

Extracellular L-Lysine Production by *M. capsulatus* Bath Heterologously Expressing Genes dapA and a gene coding for the HighK protein

| Genotype Key | Extracellular L-Lysine (uM/OD) | % RSD* | % Increase vs. Ctrl |
| --- | --- | --- | --- |
| 1067 | 2.48 | 33% | 0% |
| 1186 | 57.60 | 77% | 2225% |
| 1187 | 39.18 | 32% | 1481% |
| 1188 | 52.73 | 32% | 2028% |
| 1189 | 42.59 | 30% | 1619% |
| 1190 | 36.79 | 33% | 1385% |
| 1191 | 50.76 | 34% | 1949% |
| 1192 | 20.61 | 97% | 732% |
| 1193 | 59.18 | 24% | 2289% |

*% RSD = relative standard deviation

Figure 3:
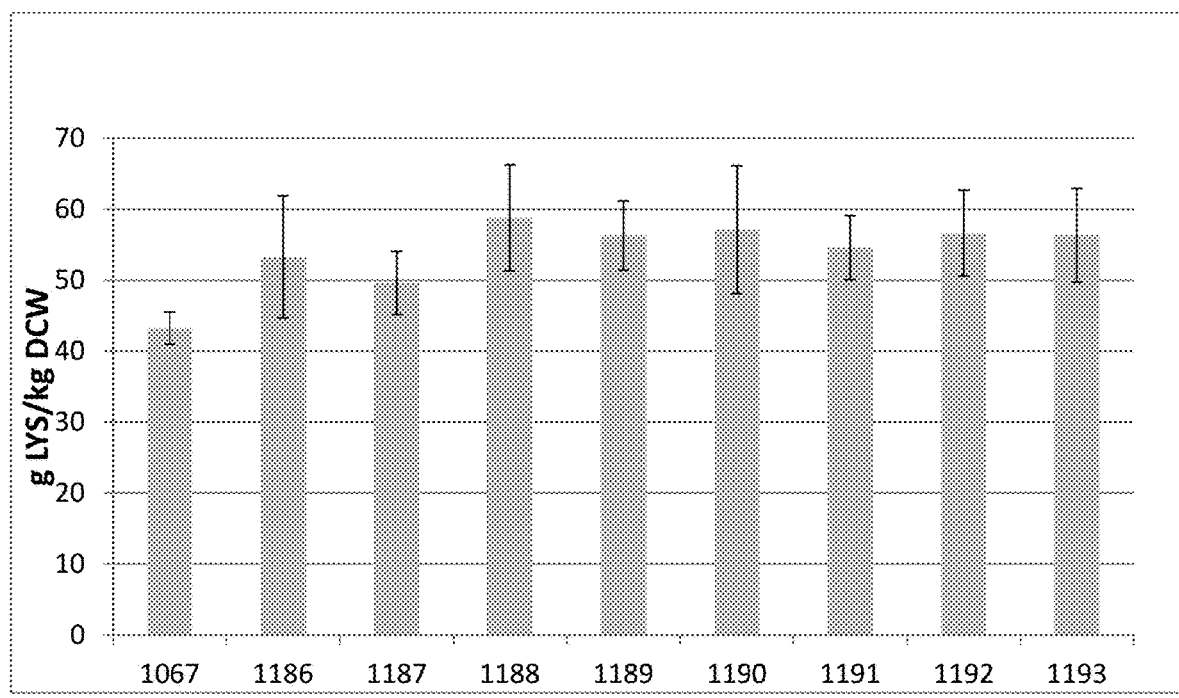
FIG. 3 provides a graphical depiction of the level of cell-associated L-lysine assayed in dry weight biomass from cultures of strains heterologously expressing a lysine-rich cache polypeptide (HighK) and dapA as described in Example 6. The bars represent the averaged values of eight clones of each experimental genotype. All HighK genes in experimental strains 1186-1193 code for the same amino acid sequence, but have different codon usages. The graph illustrates that co-expression of these genes results in a range of enhanced cell-associate L-lysine production.

The concentrations of cell-associated L-lysine assayed in cultures of strains heterologously expressing the indicated genes are depicted in FIG. 3. In the graph, Genotype key 1067 is a control expressing an unrelated gene (a fluorescent reporter gene) in the same promoter context. The bars represent the averaged values of eight clones of each experimental genotype. The experimental strains (1186-1193) contain both dapA as well as a gene coding for an L-lysine-rich protein designated HighK. All of the HighK genes code for the same amino acid sequence, but have different codon usages. It is expected that the various codon usages will modulate the amount of HighK polypeptide produced. The graph illustrates that expression of the indicated genes results in a range of cell-associated L-lysine; genotype key 1186 shows an 18% increase in this value relative to the control (1067), whereas genotype key 1188 shows a 36% increase over the control (1067).

Figure 4:
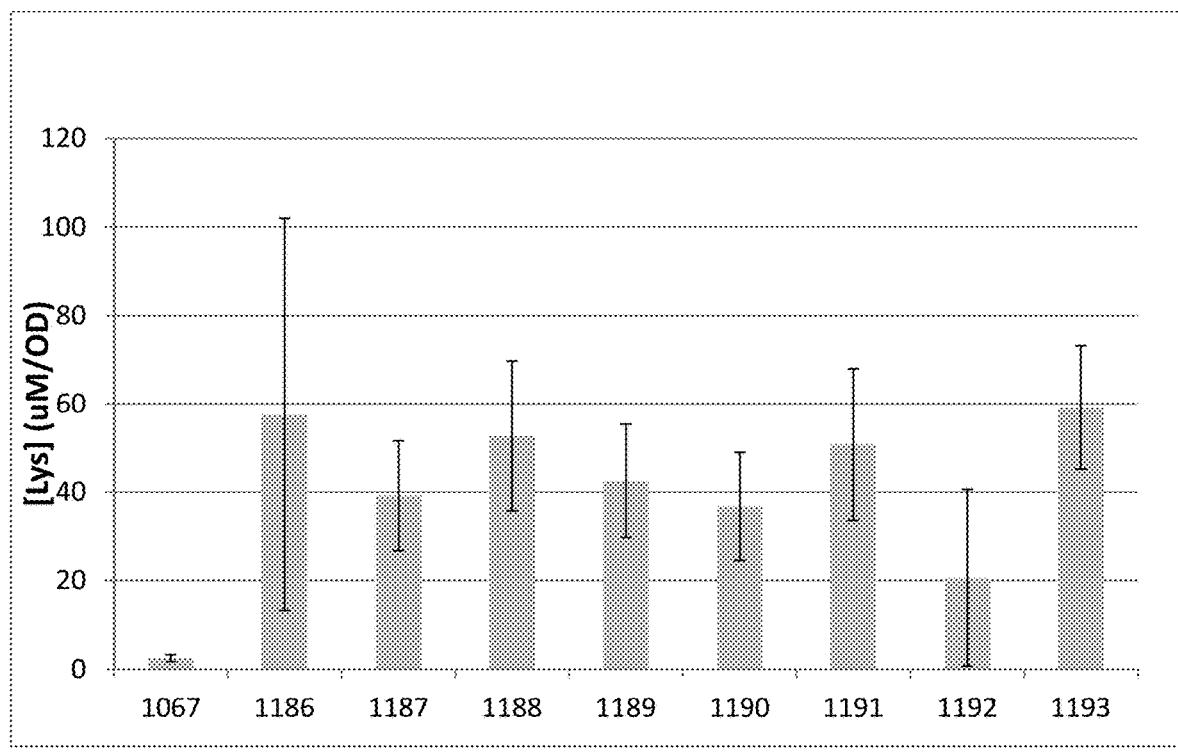
FIG. 4 provides a graphical representation of the level of extracellular L-lysine detected in culture supernatant samples of strains heterologously expressing a lysine-rich cache polypeptide (HighK) and dapA, as described in Example 6. The bars represent the averaged values of eight clones of each experimental genotype. The graph illustrates that expression of the combination of genes results in extracellular L-lysine of between 8 and 23 fold over the control (genotype key 1067), based on average values from each set of clones.

The concentrations of extracellular L-lysine detected in culture supernatant samples of strains heterologously expressing the indicated genes is depicted in FIG. 4. As in FIG. 3, Genotype key 1067 is a control expressing an unrelated gene (a fluorescent reporter gene) in the same promoter context. The bars represent the averaged values of eight clones of each experimental genotype. The graph illustrates that expression of the indicated genes results in an increase in extracellular L-lysine of between 8 and 23 fold over the control (Genotype key 1067), based on the average values from each set of clones. The results represented in FIGS. 3 and 4 demonstrate the increased production of extracellular and cell-associated L-lysine as a result of expression of the exogenous nucleic acid sequences indicated.

Example 7

Cloning and Co-Expression of Genes from Amino Acid Biosynthetic Operons in *Methanococcus capsulatus* Bath for Production of L-Lysine To create a methanotrophic bacterial strain that overproduces the amino acid L-lysine, various methanotroph expression vectors containing distinct gene combinations ("operons") encoding amino acid sequences of enzymes from *Methylococcus capsulatus* Bath and/or *E. coli* amino acid biosynthesis pathways were constructed and introduced into *Methylococcus capsulatus* Bath via conjugative mating. These operons contained the following genes:

Operon A: aspartate kinase I (thrA; SEQ ID NO:135); dihydrodipicolinate synthase (dapA; SEQ ID 121); Diaminopimelate decarboxylase (lysA; SEQ ID NO:123)

Operon B: aspartate kinase II (metL; SEQ ID NO:137); dihydrodipicolinate synthase (dapA; SEQ ID NO:121); Diaminopimelate decarboxylase (lysA; SEQ ID NO:123)

Operon C: aspartate kinase III (lysC; SEQ ID NO:139); homoserine dehydrogenase (hom; SEQ ID NO:141); dihydrodipicolinate synthase (dapA; SEQ ID NO:121); Diaminopimelate decarboxylase (lysA; SEQ ID NO:123)

Operon D: homoserine O-succinyltransferase (metA; SEQ ID NO:143); O-succinyl-L-homoserine sulfhydrylase (metZ; SEQ ID NO:145); homocysteine transmethylase (metE; SEQ ID NO:147); methionine synthase (metH; SEQ ID NO:149)

Operon F: aspartate kinase II (metL; SEQ ID NO:137); homoserine O-succinyltransferase (metA; (SEQ ID NO:143); homocysteine transmethylase (metE; SEQ ID NO:147)

Operon G: aspartate kinase III (lysC; SEQ ID NO:139); homoserine dehydrogenase (hom; SEQ ID NO:141); homoserine O-succinyltransferase (metA; SEQ ID NO:143); homocysteine transmethylase (metE; SEQ ID NO:147)

An episomal expression plasmid (containing sequences encoding origin of replication, origin of transfer, drug resistance marker (kanamycin), and multiple cloning sites), was used to clone the polynucleotide sequences of the operons noted above downstream of an engineered IPTG-inducible (LacIq) methanol dehydrogenase (MDH) promoter. Colonies of conjugation-competent *E. coli* strain (S-17) harboring either the operon-containing plasmid or a plasmid without the described promoter-operon construct (donor strains) were inoculated in liquid LB containing Kanamycin (30 μg/mL) and grown at 37° C. overnight. One part of the liquid donor culture was inoculated into 100 parts of fresh LB containing Kanamycin (30 μg/mL) for 3-5 h before they were used to mate with the recipient methanotrophic strains. Methanotrophic (recipient) strain was inoculated in liquid MM-W1 medium (Pieja et al., 2011, Microbial Ecology 62:564-573) with about 40 mL methane for 1-2 days prior to mating until they reached logarithmic growth phase ($OD_{600}$ of about 0.3).

Biparental mating was conducted by preparing the recipient and donor strains at a volume so that the $OD_{600}$ ratio was 1:1 (e.g., 5 mL of methanotroph with an $OD_{600}$ of 0.3 and 5 mL of donor with an $OD_{600}$ of 0.3). These cells were then harvested by centrifugation for 60 s at 13.2 k rpm. The supernatant was removed, and the cell pellets were gently resuspended in 500 µL MM-W1. For the *E. coli* donor strain, centrifugation and resuspension was repeated 2 more times to ensure the removal of antibiotics. Equal volumes of the resuspended cells of recipient and donor strains were then combined and mixed by gentle pipetting. The mating composition was centrifuged for 60 s at 13.2 k rpm, and the supernatant was removed as much as possible. The cell pellet was then gently mixed and deposited as a single droplet onto mating agar (complete MM-W1 medium containing sterile 0.5% yeast extract). The mating plates were incubated for 48 h in a sealed chamber containing methane and air (at a 1:1 ratio) at 37° C. After the 48 h incubation period, the cells from the mating plates were collected by adding 1 mL MM-W1 medium onto the plates and transferring the suspended cells to a 2 mL Eppendorf tube. The cells were pelleted by centrifugation and resuspended with 100 µL fresh MM-W1 before plating onto selection plates (complete MM-W1 agar medium containing kanamycin 7.5 µg/mL) to select for cells that stably maintain the constructs. Plasmid-bearing methanotrophs appeared on these plates after about 1 week of incubation at 42° C. Colonies were then grown in a shaking incubator at 42° C. in 2.5 ml liquid media (MMS1) in sealed vessels containing 1:1 methane to air ratio. After 24 hours, IPTG was added to a final concentration of 5 mM to induce expression of the target genes. After a designated time period (either 48 or 72 additional hours, depending on culturing conditions), the cultures were assayed for amino acid production.

The results in Table 9 demonstrate the increased production of extracellular L-lysine as a result of expression of the exogenous nucleic acid sequences indicated.

TABLE 9

Extracellular L-Lysine Production by *M. capsulatus* Bath Heterologously Expressing Genes Involved in Amino Acid Biosynthesis

| Strain Key | Extracellular L-Lysine Normalized to OD600 (uM/OD) | Extracellular L-Lysine, % Relative to Control |
| --- | --- | --- |
| 34 | 2.4 | 100 |
| Operon A | 6.9 | 288 |
| Operon B | 71.4 | 2955 |
| Operon C | 5.8 | 239 |
| Operon D | 8.7 | 361 |
| Operon F | 14.2 | 587 |
| Operon G | 7.5 | 310 |

For each sequence in Table 9, the highest detected assayed value of the set of clones putatively containing the sequences indicated is listed. The lower limit for designating recombinant cells as having increased lysine production was set at 2-fold higher concentrations of extracellular lysine than the assayed value for the un-altered control (i.e. the negative control strain). In several cases in which the set of clones tested putatively contained the same combination of heterologous genes, no increase in the concentration of extracellular lysine relative to the control was observed. It has been documented that the growth of *M. capsulatus* Bath is negatively impacted by even low concentrations of extracellular amino acids (Eroshin, Harwood and Pirt, 1968, *J. appl. Bact.*, 31, 560-567), suggesting that alteration of amino acid biosynthesis will likely be disadvantageous to normal cell growth. While not wishing to be bound by any theory, it is believed that alteration of native amino acid biosynthesis activity induces a high selective pressure on expressing cells to mutate or otherwise inactivate the introduced genes. Thus, the lack of activity above threshold can be caused by a number of factors (which were observed in several clones identified as being below the detection threshold) including mutations in the nucleic acid sequences or loss of the plasmid, and does not provide conclusive evidence of the presence or absence of enzyme function in that case.

Example 8

Cloning and Co-Expression of Genes from Amino Acid Biosynthetic Operons in *Methanococcus capsulatus* Bath for Production of L-Methionine To create a methanotrophic bacterial strain that overproduces the amino acid L-methionine, various methanotroph expression vectors containing four distinct gene combinations ("operons") encoding the amino acid sequences of enzymes from *Methylococcus capsulatus* Bath and/or *E. coli* amino acid biosynthesis pathways were constructed and introduced into *Methylococcus capsulatus* Bath via conjugative mating. These operons contained the following genes:

Operon B: aspartate kinase II (metL; SEQ ID NO:137); dihydrodipicolinate synthase (dapA; SEQ ID NO:121); Diaminopimelate decarboxylase (lysA; SEQ ID NO:123)

Operon D: homoserine O-succinyltransferase (metA; SEQ ID NO:143); O-succinyl-L-homoserine sulfhydrylase (metZ; SEQ ID NO:145); homocysteine transmethylase (metE; SEQ ID NO:147); methionine synthase (metH; SEQ ID NO:149)

Operon F: aspartate kinase II (metL; SEQ ID NO:137); homoserine O-succinyltransferase (metA; SEQ ID NO:143); homocysteine transmethylase (metE; SEQ ID NO:147)

Operon G: aspartate kinase III (lysC; SEQ ID NO:139); homoserine dehydrogenase (hom; SEQ ID NO:141); homoserine O-succinyltransferase (metA; SEQ ID NO:143); homocysteine transmethylase (metE; SEQ ID NO:147)

An episomal expression plasmid (containing sequences encoding origin of replication, origin of transfer, drug resistance marker (kanamycin), and multiple cloning sites), was used to clone the polynucleotide sequences of these operons (see above) downstream of an engineered IPTG-inducible (LacIq) methanol dehydrogenase (MDH) promoter. Colonies of conjugation-competent *E. coli* strain (S-17) harboring either the operon-containing plasmid or a plasmid without the described promoter-operon construct (donor strains) were inoculated in liquid LB containing Kanamycin (30 µg/mL) and grown at 37° C. overnight. One part of the liquid donor culture was inoculated into 100 parts of fresh LB containing Kanamycin (30 µg/mL) for 3-5 h before they were used to mate with the recipient methanotrophic strains. Methanotrophic (recipient) strain was inoculated in liquid MM-W1 medium (Pieja et al., 2011, *Microbial Ecology* 62:564-573) with about 40 mL methane for 1-2 days prior to mating until they reached logarithmic growth phase (OD$_{600}$ of about 0.3).

Biparental mating was conducted by preparing the recipient and donor strains at a volume so that the OD$_{600}$ ratio was 1:1 (e.g., 5 mL of methanotroph with an OD$_{600}$ of 0.3 and 5 mL of donor with an OD$_{600}$ of 0.3). These cells were then harvested by centrifugation for 60 s at 13.2 k rpm. The supernatant was removed, and the cell pellets were gently resuspended in 500 µL MM-W1. For the *E. coli* donor strain, centrifugation and resuspension was repeated 2 more times to ensure the removal of antibiotics. Equal volumes of the resuspended cells of recipient and donor strains were then combined and mixed by gentle pipetting. The mating composition was centrifuged for 60 s at 13.2 k rpm, and the supernatant was removed as much as possible. The cell pellet was then gently mixed and deposited as a single droplet onto mating agar (complete MM-W1 medium containing sterile 0.5% yeast extract). The mating plates were incubated for 48 h in a sealed chamber containing methane and air (at a 1:1 ratio) at 37° C. After the 48 h incubation period, the cells from the mating plates were collected by adding 1 mL MM-W1 medium onto the plates and transferring the suspended cells to a 2 mL Eppendorf tube. The cells were pelleted by centrifugation and resuspended with 100 μL fresh MM-W1 before plating onto selection plates (complete MM-W1 agar medium containing kanamycin 7.5 μg/mL) to select for cells that stably maintain the constructs. Plasmid-bearing methanotrophs appeared on these plates after about 1 week of incubation at 42° C. Colonies were then grown in a shaking incubator at 42° C. in 2.5 ml liquid media (MMS1) in sealed vessels containing 1:1 methane to air ratio. After 24 hours, IPTG was added to a final concentration of 5 mM to induce expression of the target genes. After a designated time period (either 48 or 72 additional hours, depending on culturing conditions), the cultures were assayed for amino acid production.

The results represented in Table 10 demonstrate the increased production of extracellular L-methionine as a result of expression of the exogenous nucleic acid sequences indicated.

TABLE 10

Extracellular L-Methionine Production by
*M. capsulatus* Bath Heterologously Expressing
Genes Involved in Amino Acid Biosynthesis

| Strain Key | Extracellular L-Methionine, Normalized to $OD_{600\,nm}$ (uM/OD) | Extracellular L-Methionine, % Relative to Control |
|---|---|---|
| 34 | 0.23 | 100 |
| Operon B | 0.64 | 275 |
| Operon D | 60.69 | 25897 |
| Operon F | 24.01 | 10245 |
| Operon G | 2.68 | 1145 |

For each sequence in Table 10, the highest detected assayed value of the set of clones putatively containing the sequences indicated is listed. The lower limit for designating recombinant cells as having increased L-methionine production was set at 2-fold higher concentrations of extracellular lysine than the assayed value for the un-altered control (i.e. the negative control strain). In several cases in which the set of clones tested putatively contained the same combination of heterologous genes, no increase in the concentration of extracellular lysine relative to the control was observed. It has been documented that the growth of *M. capsulatus* Bath is negatively impacted by even low concentrations of extracellular amino acids (Eroshin, Harwood and Pirt, 1968, *J. appl. Bact.*, 31, 560-567), suggesting that alteration of amino acid biosynthesis will likely be disadvantageous to normal cell growth. While not wishing to be bound by any theory, it is believed that alteration of native amino acid biosynthesis activity induces a high selective pressure on expressing cells to mutate or otherwise inactivate the introduced genes. Thus, the lack of activity above threshold can be caused by a number of factors (which were observed in several clones identified as being below the detection threshold) including mutations in the nucleic acid sequences or loss of the plasmid, and does not provide conclusive evidence of the presence or absence of enzyme function in that case.

Example 9

Assays for the Production of L-Lysine and L-Methionine by *Methanococcus capsulatus* Bath Culture samples from an *M. capsulatus* Bath strain containing either a vector with an IPTG-inducible (LacI$^q$) promoter-dapA construct or a vector without such a construct (both grown in the presence of 5 mM IPTG) were obtained. These samples were centrifuged for 1.5 minutes at 13.2 k rpm and both the supernatant and cell pellet were assayed for amino acid production. Cell-free supernatants were analyzed by GC-MS following derivatization with methyl chloroformate (Reference, Sue et. al). To assess amino acid composition in biomass, cell pellets were first digested in 6N HCl for 24 hrs at 100° C. with continuous agitation followed by neutralization, derivatization by methyl chloroformate, and subsequent GC-MS analysis. Quantitative analysis is performed using an Agilent 6890/5972 GC-MS system. The GC is equipped with an HP-5MS capillary column of 0.25 mm×30 m×0.25 μm dimensionality and receives helium carrier gas at a flow rate of 1 mL/min. Oven temperature program begins at 55° C. for 3 minutes, ramps to 325° C. at a rate of 20° C./min and holds for 2 minutes. 1 μL samples are injected using a Hamilton 10 μL autosampler syringe. The sample inlet is held at 250° C., has a split ratio of 15:1 and is lined with a Restek Sky precision low pressure drop inlet liner packed with glass wool.

The L-lysine derivative elutes from the column at 11.51 minutes and is quantified using the 142 m/z characteristic ion. Compound identification is verified by monitoring the qualifier ion at 88 m/z and 26% abundance relative to the target ion. Calibration standards were prepared from L-lysine dihydrochloride in deionized water. The calibration curve for L-lysine is fitted using a $1/x^2$ weighted linear regression.

The L-methionine derivative elutes from the column at 9.954 minutes and is quantified using the 61 m/z characteristic ion. Compound identification is verified by monitoring qualifier ions at 115 m/z (52% relative abundance) and 147 m/z (34% relative abundance). Calibration standards were prepared from pure methionine in deionized water. The calibration curve for L-methionine is fitted using a 1/x2 weighted linear regression.

Example 10

Stable Carbon Isotope Distribution in Biomass and Products Derived from $C_1$ Metabolizing Microorganisms Methane-derived biomass from engineered strains of *M. capsultus* Bath shown to produce elevated levels of amino acids, specifically L-lysine (Example 1), was analyzed for carbon ($^{13}C$) stable isotope ratio via elemental analyzer/continuous flow isotope ratio mass spectrometry (IRMS) using a Costech Elemental Analyzer coupled to a Thermo Delta IRMS. Samples of methanotrophic biomass cultured in serum bottles were centrifuged, washed once in deionized water, resuspended in deionized water and volumes corresponding to 0.2-2 mg carbon (about 0.5-5 mg dry cell weight) were transferred to 5×9 mm tin capsules (Costech Analytical Technologies, Inc., Valencia, Calif.) and dried at 80° C. for at least 60 hours. As controls, samples of the wild type M. capsulatus Bath and engineered M. capsulatus Bath strains expressing fluorescent protein-encoding nucleic acid sequences were cultivated in parallel, washed and resuspended in deionized water, transferred to 5×9 mm tin capsules and dried at 80° C. for at least 60 hours. Reliable $\delta^{13}C$ values are obtained for samples providing a response of ~100 to 10,000 mV within the IRMS detection window. The IRMS response range for the biomass samples analyzed ranged from 3195 to 8827 mV. Each sample was analyzed in duplicate and the average carbon ($^{13}C$) stable isotope ratios are reported in Table 11.

The isotope ratio is expressed in "delta" notation (‰), wherein the isotopic composition of a material relative to that of a standard on a per million deviation basis is given by $\delta^{13}C=(R_{sample}/R_{standard-1})\times 1,000$, wherein R is the molecular ratio of heavy ($^{13}C$) to light ($^{12}C$) isotope forms. The standard for carbon is the Vienna Pee Dee Belemnite (V-PDB). Isotope analyses were conducted by Beta Analytic Inc. (Miami, Fla.) under strict chain of custody and quality control (ISO/IEC 17025:2005 Testing Accreditation; PJLA certificate #59423). The IRMS was calibrated against NIST-8541 (graphite: −15.90+/−0.25‰) and NIST-8542 (sucrose: −10.47+/−0.13‰). A working standard calibrated against these NIST standards (Acetanilide: −33.4+/−0.3‰) was run both before and after the measurement of the unknowns. After blank correction, values measured for this secondary standard were −33.22‰ and −33.22‰. Normalization was then performed adjusting results by 0.2‰ to systematize the results to the primary NIST references. A conservative error of +/−0.3‰ (absolute) is assigned to the results to account for indeterminant error. While reproducibility in the detectors are cited by the manufacturer to be within 0.02‰, the deviation between individual runs may vary between 0.3-0.5‰ and therefore Beta Analytics Inc. cites results to the nearest 10th rather than 100th and assigns the absolute error of +/−0.3‰.

Separate M. capsulatus Bath strains constructed for inducible expression of dapA or green fluorescent protein encoding nucleic acids (see Table 11) were grown on methane in 0.5 L serum bottles containing 110 mL of defined media MMS1.0 amended with 50 ug/mL kanamycin. Kanamycin was omitted in media used to cultivate wild type M. capsulatus Bath. The strains were inoculated from 25 mL serum bottle batch cultures grown in the same media supplied with approximately 1:1 (v/v) mixture of methane and air (e.g., 60 mL methane to a headspace containing 75 mL air). The composition of medium MMS1.0 was as follows: 0.8 mM $MgSO_4*7H_2O$, 30 mM $NaNO_3$, 0.14 mM $CaCl_2$, 1.2 mM $NaHCO_3$, 2.35 mM $KH_2PO_4$, 3.4 mM $K_2HPO_4$, 20.7 μM $Na_2MoO_4*2H_2O$, 6 μM $CuSO_4*5H_2O$, 10 μM $Fe^{III}$—Na-EDTA, and 1 mL per liter of a trace metals solution (containing, per L: 500 mg $FeSO4.7H_2O$, 400 mg $ZnSO_4*7H_2O$, 20 mg $MnCl_2*7H2O$, 50 mg $CoCl_2*6H_2O$, 10 mg $NiCl_2*6H_2O$, 15 mg $H_3BO_3$, 250 mg EDTA). Phosphate, bicarbonate, and $Fe^{III}$—Na-EDTA were added after media was autoclaved and cooled. The final pH of the media was 7.0±0.1. The 110 mL volume cultures in serum bottles were inoculated to initial $OD_{600}$ of 0.1, sealed with rubber sleeve stoppers and injected with 120 mL methane gas (99% purity; grade 2.0, Praxair supplied by Alliance Gas, San Carlos, Calif.) added via syringe through sterile 0.45 μm filter and sterile 27G needles. The cultures were incubated vertically at 42° C. with rotary shaking at 250 rpm and growth was measured by withdrawing 1 mL samples to determine $OD_{600}$. When cultures reached $OD_{600}$ of at least 0.6, the bottles were vented and headspace replaced with 60 mL of the methane and 120 mL of concentrated oxygen (at least 85% purity). The headspace was replaced in this manner every 8 to 12 hours. When an $OD_{600}$ of 1.6 was reached (approx. 48 hours growth), all cultures were induced to initiate overexpression of target gene products by the addition of filter-sterilized IPTG to a final concentration of 5 mM. The cultures were grown for an additional 48 hours with headspace gas replaced as noted above. Final biomass samples were collected by centrifugation (8,000 rpm, 10 minutes), and prepared for $^{13}C$ stable isotope analysis as described above.

Table 11 provides a summary of the stable carbon isotope distribution ($\delta^{13}C$ values) for engineered strains of M. capsulatus Bath overexpressing dapA, to allow increased L-lysine production (Genotype ID 1057), as well as control strains expressing genes encoding the Dasher fluorescent protein (Genotype ID 1067) and the wild type parent strain. The results show that the $\delta^{13}C$ values are highly negative and indicate high enrichment of $^{12}C$ in methane-derived biomass and products from the strains engineered for overexpression of amino acids, fluorescent protein as well as the wild type strain of M. capsulatus Bath.

TABLE 11

Strain Descriptions and Stable Carbon Isotope Distribution for Methane-derived Biomass from engineered and control strains of Methylococcus capsulatus Bath

| Strain ID | Genotype ID | Containing Heterologous SEQ ID NO: | Genotype Description | δ13C for Biomass (‰) |
|---|---|---|---|---|
| 1781 | 1057 | 121 | dapA overexpression | −39.8 |
| 1782 | 1057 | 121 | dapA overexpression | −40.4 |
| 1783 | 1057 | 121 | dapA overexpression | −40.0 |
| 1784 | 1057 | 121 | dapA overexpression | −40.0 |
| 1785 | 1057 | 121 | dapA overexpression | −40.0 |
| 1846 | 1067 | | Green fluorescent protein overexpression (Control) | −39.9 |
| 2048 | 1067 | | Green fluorescent protein overexpression (Control) | −39.7 |
| 2049 | 1067 | | Green fluorescent protein overexpression (Control) | −39.7 |
| 105 | Wild type | | Wild type (Control) | −40.1 |

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet, including but not limited to U.S. Patent Application No. 61/928,401, are incorporated herein by reference in their entirety. Aspects of the embodiments can be modified, if necessary, to employ concepts of the various patents, applications and publications to provide further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (166 sequences)

SEQ ID NO: 1 - DNA, 1317 bp, Artificial sequence
  Synthetic construct
  CDS (1)..(1317): E. coli K12  lysine sensitive aspartokinase 3 (lysC) (codon optimized)
atgagtgagatagtggttagtaaattcggtgggactagtgtggcagactttgacgcaatgaatcggagcgcggacatcgtcctgagcgatgccaacgtgcggctggtcgtcttgagcgcctccgccggcatcaccaacctcctggtcgccgagggtcttgagcccggagagcgcttcgaaaaactggacgcgatccgcaacatccagttcgcgatccgcctccgctatcccaacgtgattcgcgaggagatcgagcgcctgcttgaaaacatcaccgtcctcgcggaagcggcggctacctcgccggccctcaccgacgagcttgtgtcccatggcgagctgatgtccacgctcttgttcgttgagatcctccgggagcgcgacgtgcaagcgcagtggttcgacgtccgcaaggtcatgcgcacgaacgaccgcttcggtcgggcggagccggacatcgcggctgagctcgcggctctccagctgctgcccaggctcaatgagggcctggtcatcacccagggcttcatcggtagcgagaataagggccggaccaccaccctcggccggggcgggtccgactacaccgcggcactgctggccgaggccctgcacgcctcgcgcgtcgacatctggaccgacgtgccgggcatctatacgacggacccacgcgtcgtcagcgctgccaagcggattgacgaaattgccttcgccgaggccgccgagatggccacgttcggcgcaaaggtcctccatccggcgaccctgctccctgcggtccgcagcgacattccggtgttcgtgggctcgtccaaggatccgcgcgccggcggcacgctggtgtgcaacaaaaccgagaacccgcccctcttccgggcgctcaggcgcaatcagacgttgctcaccctgcattcgctgaatatgcttcactcgcgcggtttcctcgccgaagtgtttggaatcctggcgaggcataacatctccgtcgatctgatcacgacctccgaggtcagcgtggccctgaccctggataccaccggctcgacctcgaccggtgataccctcctcacgcagtcgctcctcatggaactgtccgcgctgtgccgggttgaggtcgaagagggcctggccctggtggccctgatcgggaacgacctgagcaaggcatgcggcgtcggcaaagaggtctttggcgtcttggagccgttcaatatccggatgatctgttacggcgcgtcgtcgcacaatctgtgcttcctggtgcccggcgaggacgcggaacaagtcgtgcaaaagctccattccaatctcttcgag

SEQ ID NO: 2 - protein, 439 aa, Artificial sequence
  Synthetic Construct
MSEIVVSKFGGTSVADFDAMNRSADIVLSDANVRLVVLSASAGITNLLVAEGLEPGERFEKLDAIRNIQFAIRLRYPNVIREEIERLLENITVLAEAAATSPALTDELVSHGELMSTLLFVEILRERDVQAQWFDVRKVMRTNDRFGRAEPDIAAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFE

SEQ ID NO: 3 - DNA, 1248 bp, Artificial sequence
  Synthetic construct
  CDS (1)..(1248): Corynebacterium glutamicum: aspartokinase (lysC) (codon optimized)
atggcactcgttgttcaaaaatatgggggtagtagtctggaaagcgcggagaggattaggaacgtcgcagaacggatcgtggccaccaagaaagccggcaacgatgtcgtcgtggtctgctcggcgatgggcgacacgaccgacgaactgctggaactcgccgcggctgtgaatcccgtgccgccggcgcgcgagatggatatgctgctcaccgcgggcgagcgcatctcgaatgctttggtcgcgatggcgattgagtccctcggtgccgaggcgcagtcgttcaccggcagccaggctggcgtgctgaccaccgagcgccacgggaacgcgcggatcgttgacgtcacgcccggtcgggtccgcgaggccctggatgagggcaagatctgtatcgtcgccggattccagggcgtgaataaagaaacccgcgacgtgaccacgctcggtcggggcggctccgacaccactgccgtggcagcggccctgaatgccgacgtctgcgagatttacagcgacgtcgacggcgtctataccgcggatccgcggatcgtcccgaacgcgcaaaagctcgaaaagctctcgttcgaggagatgcttgagctggcggcagtgggcagcaagatactcgtgctgcgctccgtggagtacgctcgcgcgttcaatgtgcccctgcgcgtccggtcgagctattcgaacgacccaggcaccctgatcgcgggctccatggaggacatccctgtcgaggaggccgtgctgaccggcgtggcgaccgacaagtccgaggccaaggtcacggttcttggcatctccgacaaaccgggcgaggccgcgaaggtctttcgcgccgacgccgagatcaacatcgacatggtgctgcagaatgtctccagcgtcgaggacggaaccaccgacatcaccttcacgtgcccgcgctcggacggccgccgcgccatggaaatcctgaagaagcttcaggtccagggcaactggacgaatgtgctctacgatgaccaggtcggcaaagtctcgctcgttggagcggggatgaagagtcatcccggcgtcaccgcggaattcatggaagcgctccgcgacgtcaacgtgaacatcgagctgatatccacgagcgagatccgcatctcggtgctcatccgggaagatgatctggacgctgccgcacgcgccttgcacgagcaattccaactcggtggcgaggacgaggccgtggtgtacgcgggcacgggt

SEQ ID NO: 4 - protein, 416 aa, Artificial sequence
  Synthetic Construct
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRADAEINIDMVLQNVSSVEDGTTDITFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTG

SEQ ID NO: 5 - DNA, 1095 bp, Artificial sequence
  Synthetic construct
  CDS (1)..(1095): E. coli K-12 aspartate semialdehyde dehydrogenase (asd) (codon optimized)
atgaaaaatgttggttttattgggtggcggggtatggtcgggagtgttttgatgcagcggatggtcgaggaacgcgatttcgacgccatcaggccggtgttcttcagcacgagtcagctgggccaagctgcgccgtccttcggcggcacgaccggcacccttcaagacgccttcgatctggaagcgcttaaggctctcgacatcatcgtcacgtgccagggcggcgactacaccaacgagatctaccccaagctgcgggagtcgggctggcagggctactggatcgacgcggcctcctccctccgcatgaaagacgacgcgatcataattctggaccccgtgaatcaagacgtcatcaccgaccagaacggcatccgcacgtttgtgggcggcaactgcaccgtgagcctgatgctgatgtcgctcggtggcctcttcgcgaacgatctggtggattgggtgagcgtcgcgacctatcaagcggccagcggcgggggcgcacggcacatgcgcgagttgctcacccagatgggccacctctatggtcatgtggccgacgaactcgccaccccctcgtccgcgatcctggatattgagcgcaaggtcaccacgctcacccgctcgggcgagctcccggtcgacaacttcggcgtgccgcttgcgggctccctgatcccgtggatcgacaagcaactggacaacggccagagccgggaagagtggaagggccaggccgagactaataagatcctcaacacgtcgtccgtgatcccggtggacggactgtgcgtccgggtgggtgcgctgcgctgccatagccaggccttcaccatcaagctcaagaaagacgtgtcgatccctaccgtcgaggagctgcttgctgcccataatccctgggccaaagtcgtcccaaatgatcgcgagatcacgatgcgcgagctgaccccggcagcagtcacgggcaccctcaccaccccggtgggcaggctgcgcaagctgaacatgggacccgagttcctgtcggcgttcacggtcggcgaccagctcctctggggtgccgccgagccgctgcgccggatgctgcgccagctcgcg

SEQ ID NO: 6 - protein, 365 aa, Artificial sequence
  Synthetic Construct
MKNVGFIGWRGMVGSVLMQRMVEERDFDAIRPVFFSTSQLGQAAPSFGGTTGTLQDAFDLEALKALDIIVTCQGGDYTNEIYPKLRESGWQGYWIDAASSLRMKDDAIIILDPVNQDVITDQNGIRTFVGGNCTVSLMLMSLGGLFANDLVDWVSVATYQAASGGGARHMRELLTQMGHLYGHVADELATPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVEELLAAHNPWAKVVPNDREITMRELTPAAVTGTLTTPVGRLRKLNMGPEFLSAFTVGDQLLWGAAEPLRRMLRQLA

SEQ ID NO: 7 - DNA, 870 bp, Artificial sequence
  Synthetic construct
  CDS (1)..(870): E. coli F11 dihydrodipicolinate synthase (dapA) (codon optimized)
atgtttactggaagtattgtcgccatcgttacgcctatggatgagaaagggaatgtgtgtcgcgcctcgttgaaaaagctcatcgactatcatgtggcgagcggcaccctggccatcgtgagcgtcggcacgacgggcgagtcggctaccctcaaccacgatgagcacgcagacgttgtcatgatgacgctcgaactggcggacggccgcatcccggtgatcgcggggaccggtgcgaacgcgacggcagaggccatcagcctgacccagcgcttcaatgactcgggcatcgtcggttgcctgaccgtcaccccgtattacaaccggccgtcccaggagggccaacatttcaaggctatcgcggagcataccgacctcccacagatcctctacaacgtgcccagccgcaccggctgcgatctgctcccggaaaccgtgggcaggcttgccaaggtcaagaatatcatcggcatcaaggaagcgaccggcaacctcacccgcgtcaatcagattaaagaactcgtgtcggacgatttcgtgctgctgtccggtgacgacgcctccgccctggacttcatgcagctgggtggccatggcgtcatatccgtgacggccaatgtcgcagcgcgcgacatggcccaaatgtgcaagcttgcggccgagggccatttcgccgaggctcgggtcatcaaccagcgcttgatgccgctccataacaagctgttcgtggagcccaacccgattcccgtcaaatgggcgtgcaaagagctgggcctggtggcgaccgacacgctccgcctgccgatgacccccatcaccgactcgggtcgggagactgtccgggcggcgctgaaacacgccggactcctg

SEQ ID NO: 8 - protein, 290 aa, Artificial sequence
  Synthetic Construct
MFTGSIVAIVTPMDEKGNVCRASLKKLIDYHVASGTLAIVSVGTTGESATLNHDEHADVVMMTLELADGRIPVIAGTGANATAEAISLTQRFNDSGIVGCLTVTPYYNRPSQEGQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 9 - DNA, 807 bp, Artificial sequence
  Synthetic construct
  CDS (1)..(807): E. coli K-12 dihydrodipicolinate reductase (dapB) (codon optimized)
atgcacgatgcgaacattagggtggcaatagctggggcggggggaaggatgggaaggcaattgattcaggcagcgctcgaaggcgtccagctgggcgcagccctcgaacgcgagggttcctccctccttggcagcgatgcgggtgagctggctggcgccggcaagaccggggtgaccgtccagtcgagcctcgatgccgtgaaagacgacttcgacgttttcatcgacttcacgcgccccgagggcacgctcaaccacctggccttctgccggcagcatggcaagggcatggtcatcggcaccaccggctttgatgaggctggaaagcaagccatccgcgatgccgctgcggacatcgcgatcgtgttcgcggcgaatttcagtgtgggcgtcaatgtgatgctgaagctgctggagaaagccgccaaggtcatgggcgactatacggacatcgagatcatcgaagcgcatcaccggcataaagtcgacgcgccgtcgggcaccgccatgggcgaggccatcgcccatgcgctggacaaagacctgaaggactgcgcggtctactcccgcgagggccacaccggtgagcgcgtgccgggtacgatcggcttcgcgactgttcgcgcaggcgacatcgtgggcgagcatacggccatgttcgccgacatcggcgagcggcttgagatcacccataaggccagctcgcgcatgaccttcgcgaatggcgccgtccggtccgcgctctggctcagcggtaaggaatcgggcctcttcgacatgcgcgacgtcctggacctgaacaacctg

SEQ ID NO: 10 - protein, 269 aa, Artificial sequence
  Synthetic Construct
MHDANIRVAIAGAGGRMGRQLIQAALEGVQLGAALEREGSSLLGSDAGELAGAGKTGVTVQSSLDAVKDDFDVFIDFTRPEGTLNHLAFCRQHGKGMVIGTTGFDEAGKQAIRDAAADIAIVFAANFSVGVNVMLKLLEKAAKVMGDYTDIEIIEAHHRHKVDAPSGTAMGEAIAHALDKDLKDCAVYSREGHTGERVPGTIGFATVRAGDIVGEHTAMFADIGERLEITHKASSRMTFANGAVRSALWLSGKESGLFDMRDVLDLNNL

SEQ ID NO: 11 - DNA, 744 bp, Artificial sequence
  Synthetic construct
  CDS (1)..(744): Corynebacterium glutamicum: dihydrodipicolinate reductase (dapB) (codon optimized)
atgggaatcaaggtgggtgtgttgggggcgaagggtagggttgggcagacgatagtggcggcagttaatgaatcggacgatctggaactggtcgccgagatcggcgtggacgacgacctctccctcctcgtcgacaacggcgcagaagtcgtggtcgacttcaccaccccgaacgccgtcatgggcaacctggaattctgcatcaataacggcatcagcgccgtggtcggcaccacgggcttcgatgatgcgcggctggagcaagtccgcgcctggcttgagggcaaggacaatgtcggcgtgctcatcgcgccgaacttcgccattagtgccgtgctgaccatggtgttctcgaaacaagccgctcgcttcttcgagagcgccgaggtcatcgagcttcatcatcctaataagctcgacgcgccctccggcaccgcgatccacacggcccagggcatcgccgcagcccggaaagaggccggtatggacgcgcagccggacgcgactgagcaagcgctggaaggctcgcggggagcgagcgtcgacggcattccggtgcatgccgtccgcatgtccgggatggtcgcgcacgagcaagtcatcttcggcacccagggtcagaccctcacgatcaaacaggactcctacgaccgcaactcgtttgctccgggcgtcctcgtgggcgtccgcaatatcgcgcagcatcccggcctcgtggtgggtctggagcactatctgggcctg

SEQ ID NO: 12 - protein, 248 aa, Artificial sequence
  Synthetic Construct
MGIKVGVLGAKGRVGQTIVAAVNESDDLELVAEIGVDDDLSLLVDNGAEVVVDFTTPNAVMGNLEFCINNGISAVVGTTGFDDARLEQVRAWLEGKDNVGVLIAPNFAISAVLTMVFSKQAARFFESAEVIELHHPNKLDAPSGTAIHTAQGIAAARKEAGMDAQPDATEQALEGSRGASVDGIPVHAVRMSGMVAHEQVIFGTQGQTLTIKQDSYDRNSFAPGVLVGVRNIAQHPGLVVGLEHYLGL

SEQ ID NO: 13 - DNA, 1212 bp, Artificial sequence
  Synthetic construct
  CDS (1)..(1212): E. coli: bifunctional acetylornithine aminotransferase/succinyldiaminopimelate aminotransferase (codon optimized)
atggccattgagcaaactgcgatcacccgcgctacctttgacgaagttatcctccctatctatgcacccgcagagttcatcccggtgaagggccaaggctcccgcatttgggaccaacagggcaaagaatatgtcgatttcgccggtggaattgcggtgaccgccctcggccactgccatcccgccctggtgaacgcgctgaaaacccagggcgaaacgctctggcataatgtgttcaccaacgaacccgcgctcaggctggggcggaagctcatcgaggctaccttcgcggagcgcgtggtgttcatgaattccggcaccgaggcgaatgaaaccgcgttcaagctcgcgcggcattacgcctgtgtccgccacagcccgtttaagaccaagatcatcgccttccacaacgccttccacggccggtcgctctttacggtgtcggttggcggccagccgaagtatagcgacgggttcggcccgaaaccggcggatatcatccatgtccccttcaacgacttgcacgccgtcaaggccgtgatggacgaccatacgtgcgcggtcgtggtcgagccgatccagggtgagggcggagtgacggcagcgacgccagagttcctccagggcctgcgcgagttgtgcgatcagcatcaggcactcctggtgttcgatgaggtccagtgcggcatgggccgcaccggcgacctgttcgcctacatgcattacggcgtcaccccggacatcctgaccagtgcgaaggccctgggtggcggcttcccgatctccgcgatgctgaccacggccgagatcgcgtcggctttccatccggggtcccatggctcgacgtacggcggcaacccgctggcctgcgcggtggccggtgcagcgttcgacatcatcaacacccccgaggtccttgagggcatccaggccaagcggcaacgcttcgtcgaccacctccagaaaatagatcaacagtatgatgtgttcagcgacatccgcgggatgggccttctgatcggtgccgagctgaagccgcagtacaagggtcgcgccagggacttcctctacgcgggagccgaggctggcgtcatggtcctgaatgctggccccgatgtcatgcgcttcgccccgtcgctggtcgtcgaggacgcggacatcgacgagggtatgcagcggttcgcccacgccgtggcgaaagtcgtgggcgcg

SEQ ID NO: 14 - protein, 404 aa, Artificial sequence
  Synthetic Construct
MAIEQTAITRATFDEVILPIYAPAEFIPVKGQGSRIWDQQGKEYVDFAGGIAVTALGHCHPALVNALKTQGETLWHNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGRARDFLYAGAEAGVMVLNAGPDVMRFAPSLVVEDADIDEGMQRFAHAVAKVVGA

SEQ ID NO: 15 - DNA, 1173 bp, Artificial sequence
  Synthetic construct
  CDS (1)..(1173): Corynebacterium glutamicum acetylornithine aminotransferase (codon optimized)
atgtccacgcttgaaacctggccccaagtcattatcaatacttatggtaccccgcctgtcgaacttgttagcgggaagggcgcaacggtcaccgacgaccaaggcaacgtgtatatcgacctcctggccggcattgctgtgaacgcgctcggccatgcgcacccggccatcatcgaagctgtgaccaatcagatcggtcagctgggccatgtgtcgaacctgttcgcgagccgcccagttgtcgaagtcgccgaggaactgatcaagcgcttctcgctggacgacgcgaccctcgcggcccagacgcgcgtgtttttctgcaatagtggcgccgaggcgaacgaggccgcgttcaagattgcgcggctcaccggtcgcagccggatcctcgcagcagtgcatgggttccatggtcgcaccatgggctcgctcgccctcacgggccagcccgataagcgcgaggcattcctcccgatgccgtccggagtcgagttctacccgtacggcgacaccgactatcttcggaaaatggtcgagactaacccgaccgacgtcgcggcgatcttcctggagccgatccagggcgaaaccggcgtcgtccccgctcccgagggcttcctcaaagccgtgcgcgagctgtgtgacgagtacggcatcctgatgatcaccgacgaggtgcagacgggtgtgggacggaccggcgactttttcgcgcatcagcacgatggcgttgtgcccgatgtcgtgaccatggcgaagggcctgggtggcggcctgccgatcggcgcctgcttggcgacgggcagggctgccgagctcatgacgccggggaagcatggcaccaccttcggcggcaatcccgtggcgtgcgccgcagcgaaggccgtgttgtccgtggtggatgacgccttctgcgccgaggtcgcccggaagggtgagctgttcaaagagctgctcgctaaggtcgacggtgtcgtcgatgtcaggggacgcggcctgatgctcggcgtcgtgctggagcgcgacgtcgcgaagcaagccgtcctggacgggttcaaacacggcgtgatcctcaacgcccccgccgataacatcatccgcctgaccccgccgctggtcataaccgacgaagagatcgcggacgccgtgaaggccatcgcggaaaccatcgcg

SEQ ID NO: 16 - protein, 391 aa, Artificial sequence
  Synthetic Construct
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVARKGELFKELLAKVDGVVDVRGRGLMLGVVLERDVAKQAVLDGFKHGVILNAPADNIIRLTPPLVITDEEIADAVKAIAETIA

SEQ ID NO: 17 - DNA, 1119 bp, Artificial sequence
  Synthetic construct
  CDS (1)..(1119): E. coli: succinyl-diaminopimelate desuccinylase (dapE) (codon optimized)
atgtcgtgccccgtgatcgagctcacccaacaactgattcgccgcccctccctctcgccagatgatgccggatgccaggccctgctgattgagcggctgcaggccatcggcttcaccgtggagcggatggacttcgcggatacgcagaacttttgggcgtggcgcggacagggtgaaaccctggccttcgctggccatactgacgtcgtcccccctggcgacgcggaccggtggatcaacccgccgttcgagccgacgatccgcgacgggatgctgttcggcaggggcgccgccgacatgaagggcagtctggctgcgatggtcgtggccgcagagcggtttgtcgcgcagcatccgaatcataccggtcggctggcgttcctcatcacgtccgacgaagaggcctcggcccacaatggcaccgtgaaagtcgtcgaggccttgatggcgcgcaacgaaaggctcgactactgcctcgttggcgagcccagcagcatcgaagtcgtgggcgacgtcgtcaaaaatgggcgccgcggtagccttacctgtaatctgacgatccatggcgtgcaggggcatgtggcgtatccccacctggcggacaatccggtccatcgcgctgcgcccttcataaatgaactggtggcaattgagtgggaccagggcaacgaattcttcccggctacctcgatgcagatcgccaacattcaggccggcaccggttccaacaacgttatcccgggtgagctgttcgtccagttcaacttccgcttcagcaccgagctcaccgatgagatgatcaaagagcaagtgcttgcgttgctggagaagcaccaacttcgctacaccgtggactggtggctgtccggccagccgttcctcacgcgcaagctcgtggacgccgtggtcaatgccgtggagcactataacgagatcaagccgcagctcctgacgaccggtggcacgtcggatggccgcttcatcgcgcggatgggcgcacaagtcgttgagcttggcccggtcaacgccaccatccataagatcaacgaatgcgtgaatgccgcggacctccagctcctggcacgcatgtaccagcggatcatggaacagctcgtcgcc

SEQ ID NO: 18 - protein, 373 aa, Artificial sequence
  Synthetic Construct
MSCPVIELTQQLIRRPSLSPDDAGCQALLIERLQAIGFTVERMDFADTQNFWAWRGQGETLAFAGHTDVVPPGDADRWINPPFEPTIRDGMLFGRGAADMKGSLAAMVVAAERFVAQHPNHTGRLAFLITSDEEASAHNGTVKVVEALMARNERLDYCLVGEPSSIEVVGDVVKNGRRGSLTCNLTIHGVQGHVAYPHLADNPVHRAAPFINELVAIEWDQGNEFFPATSMQIANIQAGTGSNNVIPGELFVQFNFRFSTELTDEMIKEQVLALLEKHQLRYTVDWWLSGQPFLTRKLVDAVVNAVEHYNEIKPQLLTTGGTSDGRFIARMGAQVVELGPVNATIHKINECVNAADLQLLARMYQRIMEQLVA

SEQ ID NO: 19 - DNA, 822 bp, Artificial sequence
  Synthetic construct
  CDS (1)..(822): Corynebacterium glutamicum succinyl-diaminopimelate desuccinylase (dapE) (codon optimized)
atgcagtttagtaagatgcacgggctgggaaatgatttcatggttgtcgacgctgttacccaaaacgtctttttcagccccgagctgatccgcaggctggcggaccggcatcttggcgtcgggttcgatcagttgctcgttgtcgagccgccctatgacccagaactcgacttccattaccggatcttcaacgccgacggttccgaagtggcgcagtgcggcaatggcgcacggtgcttcgcgcgcttcgtgcgccttaagggcctcacgaacaagcgcgacatccgcgtgtcgaccgccaacggccggatggtcctgaccgtgaccgatgacgacctcgtgcgggtgaatatgggcgagccgaacttcgagccctcggccgtcccgttccgcgcgaacaaagccgagaaaacctatatcatgcgcgcggccgagcagacgatcctctgcggagtcgtgtccatgggtaatccgcattgcgtgattcaggtcgacgacgtggataccgccgctgtcgagactctgggccctgtgctggagagccatgagcgcttcccggagcgcgccaatattgggttcatgcaagtcgtgaagcgcgagcatatccggctcagggtctacgagcgcggcgcaggcgaaacccaggcgtgcggctcgggcgcgtgtgccgcagtcgccgtgggcatccagcaaggcctgctggccgaggaagtgcgcgtcgagctgccgggtggccgcctcgacatcgcgtggaagggtccgggccacccgctgtacatgacgggtcccgcggtccacgtgtatgacggcttcatccacctg

SEQ ID NO: 20 - protein, 274 aa, Artificial sequence
  Synthetic Construct
MQFSKMHGLGNDFMVVDAVTQNVFFSPELIRRLADRHLGVGFDQLLVVEPPYDPELDFHYRIFNADGSEVAQCGNGARCFARFVRLKGLTNKRDIRVSTANGRMVLTVTDDDLVRVNMGEPNFEPSAVPFRANKAEKTYIMRAAEQTILCGVVSMGNPHCVIQVDDVDTAAVETLGPVLESHERFPERANIGFMQVVKREHIRLRVYERGAGETQACGSGACAAVAVGIQQGLLAEEVRVELPGGRLDIAWKGPGHPLYMTGPAVHVYDGFIHL

SEQ ID NO: 21 - DNA, 813 bp, Artificial sequence
  Synthetic construct
  CDS (1)..(813): Corynebacterium glutamicum  (dapF) (codon optimized)
atgaatctgaccattccattcgccaagggccatgcgaccgagaacgacttcatcatcatacctgacgaagatgcgcgcctggacctcacccccgaaatggttgtcacgctctgcgatcggcgcgccggcatcggtgcggatggcatcctgcgcgtggtgaaagctgccgacgttgagggctcgaccgtcgacccctcgctgtggttcatggactaccgcaacgcagacggcagcctcgccgagatgtgcggcaacggcgtgcggttgttcgcccattggaagcgcggtctggtcgacaatacgtcgttcgacatcggcacccgggctggggtgcgccacgtcgatatcctccaggccgaccagcattccgcgcaagtgcgggtcgacatgggcatccccgacgtcaccggcctgtcgacgtgcgacatcaacggccaggtctttgccggtcttggcgtggacatggggaacccgcatctggcgtgcgtggtcccgggtctgtccgcgagcgcggacatggaactccgggctccgaccttcgaccaagagttcttcccgcacggcgtcaatgtcgagatcgtgaccgagctcgaagatgacgccgtgtccatgcgcgtctgggagaggggcgtgggggagactcgcagttgtggcacgggaaccgtcgcggccgcgtgcgccgcagacgcgggtctgggcgagggcaccgtcaaggtctgcgtgccgggtggcgaggtcgaagtgcagatcttcgacgatggcagcacgctcaccggaccgtccgccatcatcgcgcttggcgaggtgcagatt

SEQ ID NO: 22 - protein, 271 aa, Artificial sequence
  Synthetic Construct
MNLTIPFAKGHATENDFIIIPDEDARLDLTPEMVVTLCDRRAGIGADGILRVVKAADVEGSTVDPSLWFMDYRNADGSLAEMCGNGVRLFAHWKRGLVDNTSFDIGTRAGVRHVDILQADQHSAQVRVDMGIPDVTGLSTCDINGQVFAGLGVDMGNPHLACVVPGLSASADMELRAPTFDQEFFPHGVNVEIVTELEDDAVSMRVWERGVGETRSCGTGTVAAACAADAGLGEGTVKVCVPGGEVEVQIFDDGSTLTGPSAIIALGEVQI

SEQ ID NO: 23 - DNA, 1242 bp, Artificial sequence
  Synthetic construct
  CDS (1)..(1242): E. coli Diaminopimelate Decarboxylase (codon optimized)
atgccccatagcctcttctcgaccgacactgatttgaccgccgagaacctcctccgcctgccagccgaatttggctgcccggtctgggtgtacgacgcgcagatcatccgccggcagatcgcggctctcaaacagttcgacgtcgtccgcttcgcgcagaaagcgtgctccaacattcatatcctccggctgatgcgggagcaaggcgtcaaggtcgactccgtgtcgctcggcgagatcgagcgggcagccgggtataacccgcaaacgcatcccgacgatatagtgttcaccgccgacgtgatcgatcaggccacgctggagcgcgtgtccgagctccagattcccgtgaacgccgggagcgtggacatgctcgatcagctgggccaggtcagcccgggtcaccgcgtctggctgcgcgtgaacccgggcttcggccatggacacagtcaaaagaccaacaccggcggagagaattcgaaacatggcatttggtacaccgaccttccggcggcccttgacgtgatccagcggcatcatctgcagctcgtgggcatccacatgcacatcggcagcggcgtcgactacgcgcatctcgaacaagtctgtggagcgatggttcgccaggtcatcgagttcggccaggatctccaagcgatctccgctggggggggcctgtcggtgccgtaccagcagggtgaagaggccgtggacaccgagcactattacggcctgtggaatgctgcccgggagcagatcgctcgccatctgggccaccctgtcaagctcgaaatcgagcccggtcgcttcctcgtggcgcagtcgggcgtcctgatcacgcaagtgcgctcggtcaagcaaatgggctcgcgccatttcgtcctggtggacgcgggcttcaatgacctgatgcggccggcgatgtatggcagttaccatcatgcggccgacggtcgctccctggagcatgcaccgacggtcgaaaccgttgtcgcaggcccgctctgcgagtccggtgacgttttcacccagcaagagggcggcaacgtcgaaacccgcgcactccccgaagtcaaggccggtgactatttggtgctgcacgatacgggtgcctatggcgccagcatgagcagcaactacaattccaggccgctgctgcccgaggtcctgttcgacaatgggcaggcgaggctcatccggcgcaggcagaccatcgaggagctgctcgcgcttgagctgctg

SEQ ID NO: 24 - protein, 414 aa, Artificial sequence
  Synthetic Construct
MPHSLFSTDTDLTAENLLRLPAEFGCPVWVYDAQIIRRQIAALKQFDVVRFAQKACSNIHILRLMREQGVKVDSVSLGEIERAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 25 - DNA, 1317 bp, Artificial sequence
  Synthetic construct
  CDS (1)..(1317): Corynebacterium glutamicum diaminopimelate decarboxylase (codon optimized)
atggcaactgttgaaaactttaatgaactccccgcacatgtttggccccgcaatgctgtccgccaggaagatggcgtcgtgaccgtggcgggagtcccgctccccgacttggcagaggagtatggcaccccgctgttcgtggtcgacgaggacgacttccgctcgcggtgccgcgacatggccaccgcgttcggtggcccgggcaacgtgcattacgcgagcaaggccttcctcaccaagaccatcgcgcggtgggtcgacgaagagggcctcgccctggacatcgccagcatcaacgagctcggaatcgctgccggcttcccggcgtccaggataaccgcgcacgggaacaataaaggtgtcgagttcctccgcgcccttgtccagaacggcgtcggccatgtcgtgctggactcggcgcaggagctggaactgctggactacgtcgcagcgggcgagggcaagatccaagatgtcctcattcgcgtgaagcccggtatcgaggcccatacgcacgagttcatcgcgacgtcccacgaggaccagaaattcggtttctccctggcgagcggttcggcgttcgaggcagcaaaggccgcgaataatgccgagaacctcaatctggtgggcctgcattgccatgtgggctcccaagtgttcgacgccgagggcttcaagctcgcggctgagcgcgtgctcggctcccagatccactccgagctgggcgtcgcgctgccagagctcgacctcggtggcggctacggaatcgcgtataccgcggctgaggaaccgctgaacgtcgccgaagtggcgtcggatctgcttaccgcggtgggcaaaatggctgccgaactgggcattgacgccccgacggtcttggtcgagccgggcagggcgatcgccggaccgtccaccgtcaccatctacgaggtcggcacgacgaaagacgtgcatgtcgacgatgataagacgcgccgctacatcgccgtggacggtggcatgagcgacaatatccggcctgcgctctatggctccgagtacgatgcccgggtcgtgagccgcttcgccgagggcgacccggtttcgacgcgcatcgtgggcagtcactgtgagtcgggggatatcctgatcaacgacgagatctacccctcggacattaccagcggggacttcctcgccgccaccggcgcgtattgctacgcgatgtcgtcgcgctataacgcctttacccggccggccgtcgtgagtgtgcgggctgggagcagccgcctgatgctgaggcgcgagactctcgacgatatcctcagccttgaggcg

SEQ ID NO: 26 - protein, 439 aa, Artificial sequence
  Synthetic Construct
MATVENFNELPAHVWPRNAVRQEDGVVTVAGVPLPDLAEEYGTPLFVVDEDDFRSRCRDMATAFGGPGNVHYASKAFLTKTIARWVDEEGLALDIASINELGIAAGFPASRITAHGNNKGVEFLRALVQNGVGHVVLDSAQELELLDYVAAGEGKIQDVLIRVKPGIEAHTHEFIATSHEDQKFGFSLASGSAFEAAKAANNAENLNLVGLHCHVGSQVFDAEGFKLAAERVLGSQIHSELGVALPELDLGGGYGIAYTAAEEPLNVAEVASDLLTAVGKMAAELGIDAPTVLVEPGRAIAGPSTVTIYEVGTTKDVHVDDDKTRRYIAVDGGMSDNIRPALYGSEYDARVVSRFAEGDPVSTRIVGSHCESGDILINDEIYPSDITSGDFLAATGAYCYAMSSRYNAFTRPAVVSVRAGSSRLMLRRETLDDILSLEA

SEQ ID NO: 27 - DNA, 489 bp, Artificial sequence
  Synthetic construct
  CDS (1)..(489): E. coli:  chorismate pyruvate lyase (ubiC) (codon optimized)
atgtcccatcccgccctgactcagctgcgcgcactccggtattgcaaagaaatccccgctctcgacccccagctgttggattggctgctccttgaggactccatgaccaagcgcttcgagcaacagggtaagaccgtgtcggtcacgatgatccgcgagggcttcgtggagcaaaacgaaattcctgaggaacttccgctcctcccgaaggaatcccgctattggctgcgcgagatcctgctctgcgccgacggcgagccgtggctcgcgggcaggaccgtggtcccggtcagtacgctgtcgggcccagagctggcgctgcagaaactcggcaagacgccgctcgggcgctacctctttaccagcagcaccctgacccgggacttcatcgagatcggacgggatgcgggcctgtggggtcggcgctcgcgcctgcggctcagcggcaagccgctgctcttgaccgagctgttcctgccggacctgtac

SEQ ID NO: 28 - protein, 163 aa, Artificial sequence
  Synthetic Construct
MSHPALTQLRALRYCKEIPALDPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPDLY

SEQ ID NO: 29 - DNA, 1554 bp, Artificial sequence
  Synthetic construct
  CDS (1)..(1554): E. coli anthranilate synthase component I (trpE) (codon optimized)
atgcagacccaaaaacccactcttgagctcctgacctgtgagggtgcctatcgcgataatcccacggccctcttccatcagctttgcggggaccgccctgcgaccctgctgctcgaatccgcggacatcgactcgaaagacgacctgaagtcgctgctcctggtggactccgcgctgcggatcaccgccctcggagacaccgtgacgatccaggccttgtccgggaatggtgaggccctccttgcgctgctcgataatgctctcccggcaggcgtggagagcgagcagagcccgaactgccgggtcctgcgcttcccacccgtgtcgccgctcctcgacgaggacgccaggctctgctccctgtccgttttcgacgccttccggttgctgcaaaatctcctcaacgtgccgaaagaagaacgcgaggccatgttcttctcgggcctgtttagctacgatctggtggcaggcttcgaggatcttccgcagctgtccgcggagaacaactgccccgacttctgcttctatctggccgaaaccctgatggtgatcgaccaccagaagaagagtacgcgcattcaggcgagcctgttcgcgcccaatgaagaggagaagcagcgcctcaccgcacgcctgaacgagctccgccagcaactcaccgaagccgctccgcccctgccggtcgtttccgtgccgcacatgcgctgcgagtgcaaccagtcggatgaagagtttggcggcgtggtgcggctcctccaaaaggctatccgcgcgggagagatcttccaagtcgtcccgtcccgccggttcagtctcccgtgcccgtcgccgctggcggcgtattacgtcctcaagaaatccaatccgagcccctacatgttcttcatgcaggacaacgacttcaccctcttcggcgacgagtcgagcctgaaatatgacgccacctcgcgccagatcgagatctacccgatcgcgggcacccgcccccggggcaggcgcgcggacggctccctggatcgcgatctcgactcgcggatagagcttgagatgcgcaccgaccataaagagctctcggagcatctgatgttggtcgacctggcgcggaatgatctcgcccgcatctgcactccgggttcccgctacgtcgcggacctgaccaaagtcgaccggtattcgtacgttatgcatctggtcagccgggtcgtgggcgagctgcgccacgacctggatgcgttgcatgcgtatcgcgcgtgcatgaacatgggcacgctgagcggagccccaaaggtccgggccatgcagctgatcgccgaggctgagggcaggcgccggggtagctacggcggcgccgtgggctactttacggcgcatggcgatctggacacgtgcatcgtcattcgctcggcgctcgtcgagaatgggatcgcgaccgtgcaggccggtgcgggcgtcgtgctggactccgtgccccagagcgaagccgacgaaacgcgcaataaggccagggccgtccttcgcgcgattgcaaccgcacaccatgcgcaagaaaccttc

SEQ ID NO: 30 - protein, 518 aa, Artificial sequence
  Synthetic Construct
MQTQKPTLELLTCEGAYRDNPTALFHQLCGDRPATLLLESADIDSKDDLKSLLLVDSALRITALGDTVTIQALSGNGEALLALLDNALPAGVESEQSPNCRVLRFPPVSPLLDEDARLCSLSVFDAFRLLQNLLNVPKEEREAMFFSGLFSYDLVAGFEDLPQLSAENNCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGDESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 31 - DNA, 1530 bp, Artificial sequence
  Synthetic construct
  CDS (1)..(1530): Corynebacterium glutamicum anthranilate synthase component (trpE) (codon optimized)
atgtccaccaatccacatgttttctccctcgacgtccggtatcatgaagatgcgagcgccctcttcgcccatctgggcggcacgaccgcggatgacgcggcactgctggagtccgcggacatcaccaccaaaaacgggatcagcagcctggccgtgctcaagtccagcgtgcggatcacctgtacgggcaacaccgtggtcacgcaaccgctgaccgactcgggtcgcgccgtcgttgcccgcctgacccaacagctcggacagtataacaccgccgagaacaccttcagcttccctgcgtccgacgccgtggacgagcgcgagaggctgacggctccctcgaccatcgaggtcctgcggaaactccagttcgagtccggctattccgacgcctcgctgccgctgctgatgggtggcttcgcatttgacttcctggagactttcgagactctgcccgccgttgaggaatccgtcaacacctatcccgactaccagttcgtgctggccgagatcgtgctcgacattaaccatcaggaccaaacggcgaagcttaccggcgtgtcgaatgcaccgggtgagctcgaagctgagctgaacaagctgtccttgctgatcgacgctgcgctcccggcgaccgagcatgcgtaccagaccaccccgcacgatggcgataccttgcgcgtcgtcgccgacattccggatgcccagttcaggacccaaatcaacgaactgaaagagaacatctacaacggcgatatctaccaagtcgtgccggcgcgcaccttcacggcaccgtgccctgacgcgttcgcggcgtatctgcagctgcgggcgaccaatccgagcccctatatgttctacatccggcaggagggccgctcgtacgaacttttcggcgatgagtcgaatctcaagttcacggccgctaaccgcgagctccagctttacccgatcgccgggacgcgcccccgccagccggacggcagtatcaatgacgagctggacatccgcaatgaactcgacatgcgcaccgatgcgaaagaaatcgcggatgacacgatgctcgtggacctggcccgcaacgaccttgcacgggtgagcgtcccggccagccgccgggtggcggacctcctccaagtggaccgctattcgcgcgtgatgcacctcgtgtcgcgcgtcaccgcgacgctcgaccccgagctcgatgccctggacgcctaccgggcttgcatgaatatgggcacgctcaccggagcgcccaagctccgggccatggaattgctgaggggcgtcgagaagcgcaggcgcggttcgtacggtggcgccgttggctatctgcgcggcaacggcgacatggacaattgcatcgtcattcggagtgcgtttgtccaggacggcgtggctgcggtccaggccggggctggcgtggtgcgcgacagcaacccgcagtccgaagcggacgagactctccacaaggcctacgccgtcctcaatgcgatcgccgcgggttcgacccttgaggtcatacgc

SEQ ID NO: 32 - protein, 510 aa, Artificial sequence
  Synthetic Construct
MSTNPHVFSLDVRYHEDASALFAHLGGTTADDAALLESADITTKNGISSLAVLKSSVRITCTGNTVVTQPLTDSGRAVVARLTQQLGQYNTAENTFSFPASDAVDERERLTAPSTIEVLRKLQFESGYSDASLPLLMGGFAFDFLETFETLPAVEESVNTYPDYQFVLAEIVLDINHQDQTAKLTGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRQEGRSYELFGDESNLKFTAANRELQLYPIAGTRPRQPDGSINDELDIRNELDMRTDAKEIADDTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIAAGSTLEVIR

SEQ ID NO: 33 - DNA, 1575 bp, Artificial sequence
  Synthetic construct
  CDS (1)..(1575): E. coli: anthranilate synthase component II (trpG) (codon optimized)
atggccgacatcctcctccttgacaatattgactcgttcacgtataatctcgccgatcagctgcgcagtaacggccataacgttgtgatctatcggaaccatatccctgcgcagaccctgatcgagcgcttggccaccatgtccaaccccgtgctcatgctgtccccgggtcccggcgtcccgtccgaggccggctgcatgccagagctgctgacccgcctgcggggtaagctgcctattatcggcatctgcctgggtcatcaggccatcgtcgaggcctacggcggctacgtggggcaggccggtgagatcctccacggcaaagcgtcctcgattgagcatgacggccaggctatgttcgcgggactcacgaatccgctcccggtggcgcgctaccattcgctcgtcggctccaacatccccgctggcttgaccatcaatgcgcatttcaacgggatggtgatggccgtccggcacgatgcggaccgcgtctgcggtttccagttccatccggagagcatcctcaccacccagggcgcacgcctgctggagcaaaccctggcgtgggcgcagcacaagcttgagccggctaatacccttcaacccatcaagctgtatcaggcccaaacgctgtcgcaacaagagtcgcatcagctgttctcggccgtggtcaggggcgagctgaagccagaacagctcgcggcagctttggtgagcatgaaaatccgcggcgagcaccccaacgaaatcgccggcgctgccacggcgcttttggagaacgcagcgccgttccccaggccggactacctcttcgcggacatcgtgggcacgggtggcgacggctcgaattcgatcaacatttcgaccgcgagcgcgtttgtcgcagccgcgtgtggcctgaaagtcgcgaaacatggcaatcggtccgtgagcagcaagagcggctccagcgacctcctggcggcgttcggcataaacctggacatgaacgccgacaagagccggcaggctctcgatgaactcggggtctgcttcctgttcgcgccgaagtaccatacgggattccggcacgcgatgccggtgcgccagcaactcaagactcgcaccctctttaatgtcctcggcccgctcatcaatccggcgcatccgccgctggccctgatcggggtgtattcccccgagcttgtcctcccgatcgcggagactctgcgcgttctcggctatcagcgggcagccgtggtgcactcgggcggaatggacgaggttagtctgcacgcccccaccatagtggccgagctccatgacggcgagatcaaatcgtatcagctgaccgccgaggacttcggcctcacgccctaccatcaagaacagctggcgggtggcaccccggaagagaaccgcgatatcctgacgcgcctgctccagggcaagggtgacgctgcgcatgaagccgccgtcgccgcgaacgtcgcgatgctgatgcgcctccacgggcacgaagatctgcaggccaacgcccagaccgtccttgaagtgctgcgctccggcagcgcctacgaccgggtcaccgcacgc

SEQ ID NO: 34 - protein, 525 aa, Artificial sequence
  Synthetic Construct
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQHKLEPANTLQPIKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTAR

SEQ ID NO: 35 - DNA, 624 bp, Artificial sequence
  Synthetic construct
  CDS (1)..(624): Corynebacterium glutamicum: anthranilate synthase component II (trpG) (codon optimized)
atgacccacgtcgtcctgatagataaccatgactccttcgtttacaaccttgtcgacgccttcgccgtcgccggctacaagtgcaccgtgttcaggaacaccgtcccggtggaaacgatcttggcagcgaatccggacctgatctgcctctcgcccggaccggggtatccggccgacgcgggcaatatgatggcgctcatcgagcgcaccctcggccaaattccgctgctgggtatctgcctcggctatcaggccctgatcgagtaccacggcgggaaagtcgagccctgtggcccggtgcatggaactaccgataacatgatcctcaccgatgctggtgtgcagtccccggtctttgcgggccttgcgaccgacgtggagccggaccatcccgagatcccaggccgcaaggtccccatcggccggtatcactcgctcggctgcgtggtggcgcctgacggtatcgagtcgctgggcacgtgcagcagtgagatcggcgacgtcattatggcagcccgcacgaccgacggcaaggccatcggcctccagttccatccggagagcgtgctgagccccacgggtccggtgatcctgtcccggtgcgtcgaacagctgctcgcgaat

SEQ ID NO: 36 - protein, 208 aa, Artificial sequence
  Synthetic Construct
MTHVVLIDNHDSFVYNLVDAFAVAGYKCTVFRNTVPVETILAANPDLICLSPGPGYPADAGNMMALIERTLGQIPLLGICLGYQALIEYHGGKVEPCGPVHGTTDNMILTDAGVQSPVFAGLATDVEPDHPEIPGRKVPIGRYHSLGCVVAPDGIESLGTCSSEIGDVIMAARTTDGKAIGLQFHPESVLSPTGPVILSRCVEQLLAN

SEQ ID NO: 37 - DNA, 1575 bp, Artificial sequence
  Synthetic construct
  CDS (1)..(1575): E. coli anthranilate phosphoribosyltransferase (trpD) (codon optimized)
atggccgacatcctgctgctcgacaatatcgactcgttcacctacaatctcgccgatcaactgcgctccaacggccacaacgtcgtgatctatcgcaatcatatcccagcgcagaccctcattgagcgcctggcgaccatgtccaacccggtgctcatgctcagtcccggcccgggcgtcccgtccgaggccggctgcatgcccgagctgctgacccgcttgcgcgggaagctgccgatcatcggcatttgcctgggccatcaggccatagtcgaggcgtacggcggctatgtcggccaggccggtgagattctccacggcaaggcatccagcatcgagcatgacggccaagcgatgttcgccggtctgacgaacccgctgccggtcgcccggtaccattcgctggtcggatcgaatatccccgctggtctgaccatcaacgcgcatttcaacggcatggtgatggctgtgcggcatgacgccgaccgcgtctgcgggtttcaattccatccggagtcgatcctgaccactcagggtgcgcgcctgcttgagcagaccctcgcttgggcccagcagaaattggagccggcgaatacgctccagcccatcaagctgtaccaggctcagaccctcagtcaacaggagtcccatcagttgttcagcgccgtcgtccggggagagctcaagcccgagcaactggctgccgccctggtgagcatgaagattcgcggagagcaccccaatgaaatcgcgggtgcggccaccgcgctgctggagaatgccgcaccgttccctcgcccggactatctcttcgcggacatcgtgggcacgggtggcgatggcagcaacagcatcaacatatcgacggcgagcgcgttcgtcgccgcagcgtgcggcctgaaagttgcgaaacacgggaaccggtcggtgagctcgaagtccggctcctccgacctcctggccgccttcggcatcaacttggatatgaatgccgacaaatcgcgccaagccctggacgaactgggcgtgtgttttcttttcgcgccgaagtaccatacgggcttccggcatgccatgccggtcaggcagcaactcaagacgcgcaccctcttcaacgtgctgggtccgctcatcaaccccgcacacccgcctcttgccctgatcggcgtctattcccccgagctcgtcctcccgatcgcggaaacgctcagggtgctgggctatcagcgggcagccgttgtgcattcgggtggcatggacgaagtctcgctgcacgcgccgacgatcgttgctgagctccacgacggcgagatcaagtcgtaccagctcaccgccgaggatttcggccttaccccctatcatcaagagcagctcgccgggggcaccccggaagagaaccgcgacatcctgacccgcctcctccagggcaagggcgacgcagcccacgaagctgcggtggcggcgaatgtcgccatgctgatgcgcctgcatgggcacgaagatctccaggcgaacgcgcagaccgtgcttgaggtcctccggtccggcagcgcgtacgaccgcgtgactgcgcgg

SEQ ID NO: 38 - protein, 525 aa, Artificial sequence
  Synthetic Construct
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPANTLQPIKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTAR

SEQ ID NO: 39 - DNA, 1032 bp, Artificial sequence
  Synthetic construct
  CDS (1)..(1032): Corynebacterium glutamicum anthranilate phosphoribosyltransferase (trpD) (codon optimized)
atgaccagtccggccaccctcaaagtccttaacgcgtatctcgacaacccgacccccactctggaagaagcgatcgaggtgttcactccgctcaccgtgggcgagtacgacgacgtccacatcgctgcgctgctggccaccatccgcacgcggggtgaacagttcgcggacattgccggtgccgccaaggccttcctcgccgctgcgaggcccttccccatcaccggagccggcctgctggactcggcgggtacgggtggggacggcgcgaataccatcaatatcacgacgggcgctagcctgatcgcggcatccgggggcgtcaagctcgtgaagcatggcaaccggagcgtgtcgtccaagagcggctccgccgacgtgctggaagcactgaacatcccgttgggactcgacgtcgaccgcgctgtcaaatggttcgagaacttcacgttcctgttcgcgccagcgtacaacccggccatcgcgcatgtgcaaccggttcgccaggccctgaagtttccgacgatattcaacaccctcggcccgctgctgagcccggctcgccctgagcggcagatcatgggtgtcgcgaatgcgaaccatggccagctgatcgccgaagtgtttcgcgagctcggccgcacccgggcactcgtggtccatggtgccgggaccgatgagatcgcggtccacggcacgaccctggtctgggaactcaaggaggacggcaccattgagcattatacgatcgagcccgaggatcttggcctgggccgctatacccttgaggacctcgttgggggcctgggcaccgagaatgccgaggccatgcgcgcgaccttcgccggcaccggtcccgatgcgcaccgggacgcggcctcggccggagccatgttctacctcaatggcgacgtcgattccctcaaggacggcgcacaaaaggccttgtcgctcctggccgacggcaccacccaggcgtggctggcgaaacacgaagagatcgactactcggagaaagagagctccaatgat

SEQ ID NO: 40 - protein, 344 aa, Artificial sequence
  Synthetic Construct
MTSPATLKVLNAYLDNPTPTLEEAIEVFTPLTVGEYDDVHIAALLATIRTRGEQFADIAGAAKAFLAAARPFPITGAGLLDSAGTGGDGANTINITTGASLIAASGGVKLVKHGNRSVSSKSGSADVLEALNIPLGLDVDRAVKWFENFTFLFAPAYNPAIAHVQPVRQALKFPTIFNTLGPLLSPARPERQIMGVANANHGQLIAEVFRELGRTRALVVHGAGTDEIAVHGTTLVWELKEDGTIEHYTIEPEDLGLGRYTLEDLVGGLGTENAEAMRATFAGTGPDAHRDAASAGAMFYLNGDVDSLKDGAQKALSLLADGTTQAWLAKHEEIDYSEKESSND

SEQ ID NO: 41 - DNA, 1344 bp, Artificial sequence
  Synthetic construct
  CDS (1)..(1344): E. coli  (trpC) (codon optimized)
atgcaaactgtccttgccaaaattgttgcagataaagctatatgggtcgaagcgcgcaaacaacagcagcccctcgcgtcgttccagaatgaggtccaaccgtcgacccgccatttctacgacgccttgcagggcgcccggacggcgttcatctgcaaaaaagactccaagggcgtcattcgcgatgacttcgaccctgcgcggatcgcggcgatctacaagcactacgcgagtgccatcagcgtgctcaccgatgagaagtatttccgcggctcctttaacttcctcccgatcgtgtcccagatagcgccgcagccgatcctgtgcaaggacttcatcatcgacccgtatcagatttatctggcgcggtactatcaggccgatgcctgcctgctgatgctctcggtgctggacgacgaccagtaccggcaactcgctgccgtcgcgcacagccttgagatgggtgtcctcaccgaggtttcgaacgaggaagaacaggagcgcgcgatcgccctcggtgccaaagtcgttggcatcaataaccgggacttgcgcgacctgtccatcgaccttaacaggacccgcgagctcgcgccgaagcttggccataacgtgaccgtgatcagcgagagtggcatcaacacgtatgcccaggtgcgcgagctgtcgcatttcgccaacggattcctgatcggctccgccctcatggcgcatgacgatctgcacgcggctgtccgcagggtgctcctgggcgagaacaaggtctgcggcctgaccaggggccaagacgcgaaggctgcgtacgatgccggtgccatctacggcggactcatcttcgtggccacgagcccccggtgcgtcaatgtcgagcaagcgcaagaggtcatggccgcagccccgctgcagtatgtcggcgtgttccgcaaccacgacatcgccgacgtcgtggacaaggcaaaggtcctcagcctggtggcagtgcagctgcatggtaacgaggaacagctctacatcgacaccctccgcgaggccctgcccgcccatgtcgcaatttggaaggccctgtcggtcggggaaacgctcccagcgcgcgagtttcaacatgtggacaagtatgtcctcgacaatggccagggcggctcgggccagcgcttcgactggtccctgctgaatggccagacgctgggcaatgtgctcttggctggcggccttggcgccgataattgtgtcgaggctgcgcagaccgggtgcgccggtctggatttcaactcggcagtggagagccagcccgggatcaaggatgcgcggctcctggcgagcgtgttccagaccctccgggcctac

SEQ ID NO: 42 - protein, 448 aa, Artificial sequence
  Synthetic Construct
MQTVLAKIVADKAIWVEARKQQQPLASFQNEVQPSTRHFYDALQGARTAFICKKDSKGVIRDDFDPARIAAIYKHYASAISVLTDEKYFRGSFNFLPIVSQIAPQPILCKDFIIDPYQIYLARYYQADACLLMLSVLDDDQYRQLAAVAHSLEMGVLTEVSNEEEQERAIALGAKVVGINNRDLRDLSIDLNRTRELAPKLGHNVTVISESGINTYAQVRELSHFANGFLIGSALMAHDDLHAAVRRVLLGENKVCGLTRGQDAKAAYDAGAIYGGLIFVATSPRCVNVEQAQEVMAAAPLQYVGVFRNHDIADVVDKAKVLSLVAVQLHGNEEQLYIDTLREALPAHVAIWKALSVGETLPAREFQHVDKYVLDNGQGGSGQRFDWSLLNGQTLGNVLLAGGLGADNCVEAAQTGCAGLDFNSAVESQPGIKDARLLASVFQTLRAY

SEQ ID NO: 43 - DNA, 1398 bp, Artificial sequence
  Synthetic construct
  CDS (1)..(1398): Corynebacterium glutamicum bifunctional Indole-3-glycerol phosphate synthase/phosphoribosylanthranilate isomerase (trpC)
atgacctccaacaatctcccaaccgttcttgagtccatagtcgaaggccgccgcggacatctcgaagaaatccgggcgaggatcgcccacgtggacgtcgacgcgctcccgaagtccacgcgcagcctgttcgatagcctgaatcagggtcgcggcggcgcgcgcttcatcatggagtgcaagagtgactccctgggcatgatccgggagcactaccagccgggcgagatcgcgagggtctactcgcgctacgcgagcgggatctccgtcctgtgcgagcccgaccgcttcggtggcgattacgaccatctcgccacggtcgccgccacctcgcatctgcccgtgctgtgcaaagacttcatcatcgaccccgtgcaagtgcatgctgcgcggtatttcggcgctgacgcgatcctcttgatgctgtcggtgttggacgacgaagagtatgcggcagccgaggccgcacgcttcgacctggatatcctgaccgaagtcattgacgaagaggaagtcgcgcgggcgatcaaactcggtgcgaagatatttggcgtgaaccaccggaacctccatgacctcagcatcgatctggaccgctcccggcgcctgtcgaagctgatcccggccgacgccgtcctggtgagcgagagtggcgtgcgggatacggaaaccgtccggcaactgggcggacacagcaacgccttcctggtgggtagtcagctgacctcccaggagaacgtggatctggcagcgcgcgagctcgtctatggcccgaacaaggtctgcggcctcacctcgcctagcgctgcccagaccgccagggccgcgggcgcggtctatggcggcctcatcttcgaggaggaccgcaacgtgtcccgcgagactctgcagaaaatcattgcggcggagccgaatctccgctacgtggccgtttcgaggcgcacgtcgggctacaaagatctccttgtcgacggcatcttcgcggtccagattcacgcaccgttgcaggacagcgttgaggccgagaaagccctcatcgcggccgtccgcgaggaggtcggtccccaggtgcaagtctggcgggctatctccatgagcagcccgctgggggctgaggtcgccgcagcggtcgagggcgacgtggacaagctcatcctggacgcgcatgagggcgggtcgggtgaagtgttcgactgggcaaccgtcccggcagccgtgaaggccaagtcccttcttgctggcgggatctcgccggataatgccgcgcaagccgtgggctgcgcgggactggacatcaattcgggcgtggagtatccggcgggcgccggcacctgggcgggtgccaaagacgccggtgccctgctcaagatctttgcgacgatttcgacgttccattat

SEQ ID NO: 44 - protein, 466 aa, Artificial sequence
  Synthetic Construct
MTSNNLPTVLESIVEGRRGHLEEIRARIAHVDVDALPKSTRSLFDSLNQGRGGARFIMECKSDSLGMIREHYQPGEIARVYSRYASGISVLCEPDRFGGDYDHLATVAATSHLPVLCKDFIIDPVQVHAARYFGADAILLMLSVLDDEEYAAAEAARFDLDILTEVIDEEEVARAIKLGAKIFGVNHRNLHDLSIDLDRSRRLSKLIPADAVLVSESGVRDTETVRQLGGHSNAFLVGSQLTSQENVDLAARELVYGPNKVCGLTSPSAAQTARAAGAVYGGLIFEEDRNVSRETLQKIIAAEPNLRYVAVSRRTSGYKDLLVDGIFAVQIHAPLQDSVEAEKALIAAVREEVGPQVQVWRAISMSSPLGAEVAAAVEGDVDKLILDAHEGGSGEVFDWATVPAAVKAKSLLAGGISPDNAAQAVGCAGLDINSGVEYPAGAGTWAGAKDAGALLKIFATISTFHY

SEQ ID NO: 45 - DNA, 1347 bp, Artificial sequence
  Synthetic construct
  CDS (1)..(1347): E. coli tryptophan biosynthesis protein (trpCF) (codon optimized)
atgatgcaaaccgttctcgcaaagatagtcgctgacaaggccatttgggttgaaactcgcaaacaacagcaacctctcgcgtcgtttcagaacgaaatccagccctcgaccaggcatttctacgatgccctccagggtgcgaggaccgccttcatctgcaaaaaagactccaagggcgtcatccgcgacgacttcgacccagcccgcatcgcggccatctataagcattacgcgagtgctatcagcgtgctcaccgatgagaagtacttccagggctcgttcgacttcctgccgatagtgtcccagatcgcgccgcagccgattctgtgcaaagatttcatcatcgatccctatcagatttatctggcgcgctactaccaagccgacgcatgcctccttatgctcagcgtcctggacgacgagcagtatcggcagctggccaccgtggcccattccctggaaatgggtgtgctgaccgaagtgagcaacgaagaggagctcgaacgggcgatcgcgctgggtgccaaggtcgtcggaatcaataaccgcgacctccgcgatctgtccattgacttgaaccgcacgcgcgagctggccccgaagctcgggcacaacgtcaccgtgatctccgagagcggcatcaatacctatgcgcaagtgcgcgagctgtcgcatttcaccaatggcttcctcatcggctcggcactgatggcccatgacgacctcaacgctgcggtccggcgggtgctcctgggtgagaacaaagtgtgcggccttacgcgggagcaagacgcaaaagctgcctatgacgctggcgcgatctacggcgggctcatcttcgtggcgacgagcccgcgctgcgtcaatgtcgagcaagcgcaggaggtcatggccgcagccccgctgcaatacgtcggcgtctttcgcaaccacgacatcgccgacgtcgtcgataaggccaaggtcctgagtcttgcggccgtgcagctccatggcaatgaggatcagctgtatatcgacaccctccgcgaggcacttccggcgcacgtggcgatctggaaggctctgtccgtgggtgagactctgccggcgcgggacttccagcacatcgacaaatacgtgttcgacaatgggcagggcggctcgggccagcggttcgactggagcctgctgaacggccagtccctgggcaatgtgctcctggccggcggactcggcgccgacaattgcgtcgaggccgcgcagacgggttgtgcgggcctggacttcaactcggccgtcgagagccagcccggcatcaaagacgcgaggctcctggcgtcggtgttccaaacgttgcgggcgtac

SEQ ID NO: 46 - protein, 449 aa, Artificial sequence
  Synthetic Construct
MMQTVLAKIVADKAIWVETRKQQQPLASFQNEIQPSTRHFYDALQGARTAFICKKDSKGVIRDDFDPARIAAIYKHYASAISVLTDEKYFQGSFDFLPIVSQIAPQPILCKDFIIDPYQIYLARYYQADACLLMLSVLDDEQYRQLATVAHSLEMGVLTEVSNEEELERAIALGAKVVGINNRDLRDLSIDLNRTRELAPKLGHNVTVISESGINTYAQVRELSHFTNGFLIGSALMAHDDLNAAVRRVLLGENKVCGLTREQDAKAAYDAGAIYGGLIFVATSPRCVNVEQAQEVMAAAPLQYVGVFRNHDIADVVDKAKVLSLAAVQLHGNEDQLYIDTLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 47 - DNA, 1398 bp, Artificial sequence
  Synthetic construct
  CDS (1)..(1398): Corynebacterium glutamicum tryptophan biosynthesis protein (trpCF) (codon optimized)
atgactagtaataatttgccaacggtcttggagagtatagttgaggggaggcgcggacatctggaagaaattcgcgcgcggatcgcccatgtcgacgtggacgcgctgccgaagtccacccgcagcctgttcgacagcctcaaccagggtaggggcggagcgcgctttatcatggaatgcaaatccgactccctgggcatgatccgcgagcattatcagccgggtgagattgcacgcgtctactcgcggtacgcgagcggcatctccgtcctgtgcgagccggaccgctttggcggcgactatgatcatctggcgaccgtggcggcgacgagccatctcccggtcctctgcaaagacttcatcatcgaccccgttcaggtccatgctgcccggtacttcggcgcagacgccatcctgctgatgctgtcggtgctcgacgatgaagagtatgccgctgccgaggccgctcgcttcgacctcgacattctgaccgaggtcatcgacgaggaagaggtcgcacgggccatcaagctcggcgccaagatcttcggcgtcaaccaccgcaaccttcacgatctttcgatcgacctggaccggtcgcggcggctgtccaagctcatcccagcggacgccgtcctggtgtcggagtccggcgtgcgcgataccgagactgtgcggcagctgggtggacatagcaatgcgttcctcgtggggagccagctgacctcgcaagagaacgtcgacctggctgcgcgcgagcttgtgtatggcccgaacaaagtgtgcggtctgacgagcccctcggcagcccagacggcgcgcgcggctggcgccgtgtacggtggcctcatcttcgaggaagatcggaacgtgtccagggaaacccttcaaaagattatcgcggcggagccgaatttgcgctacgtcgccgtgtcgcggcgcacgagcggctacaaagacctcctcgtggacggcatcttcgccgtccagatccacgcgccgctccaggactccgtcgaggccgagaaggccctcatcgctgcggttcgcgaagaggttggcccccaggtccaagtctggcgcgcgatatccatgtcgtcgcccctcggcgcagaagtcgcggcagcggtcgagggcgatgtggacaagctgatcctcgacgcccacgagggcggctccggcgaggtgttcgattgggccaccgtcccggcagcggtgaaggccaagtcgctgctcgccggtggcatcagccctgacaatgccgcccaagccgtgggatgcgccggcctcgacatcaactcgggcgtggagtatccggctggtgcgggcacctgggcgggggcgaaagatgccggtgcgctcctgaagatcttcgcgaccatctcgaccttccactac

SEQ ID NO: 48 - protein, 466 aa, Artificial sequence; identical to SEQ ID NO: 44
  Synthetic Construct

SEQ ID NO: 49 - DNA, 1347 bp, Artificial sequence
  Synthetic construct
  CDS (1)..(1347): E. coli  fused indole-3-glycerolphosphate synthetase/N-(5-phosphoribosyl)anthranilate Isomerase (trpF) (codon optimized)
atgatgcaaaccgttctcgcaaagatcgtcgccgacaaagcaatatgggtcgaagccaggaaacaacaacagccactggcgtcgttccagaacgaggtccagccgtccacgcggcacttttatgacgccctccagggtgcccggacggcgttcatctgcaagaaggacagtaagggcgtgatccgggacgacttcgacccggcgcggattgcggcgatctataagcactacgccagcgcgatctcggtgctcaccgacgagaagtacttccagggcagctttaacttcctcccgatagtcagccagatcgccccgcagccgatcctgtgtaaagacttcatcatcgacccgtaccaaatctatctggcgcggtactatcaggctgacgcgtgcctcctgatgctgtcggtcctcgacgatgatcagtaccgccagctcgctgcggtggcccattcgcttgagatgggcgtcctgaccgaagtctccaatgaagaggaacaggaacgcgcgatcgccctgggggccaaggttgtcggcatcaacaatcgggatctgcgggacctgtccatcgacctcaatcgcacccgcgagttggcgccgaagctcggccacaacgtcaccgtgattagtgagagcggcatcaatacttatgcccaggtgcgcgagctctcccatttcgcgaatgggttcctgatcggctcggcgcttatggcgcatgatgatctccatgcggccgtccgcagggtgctgctcggcgagaataaagtctgcggcctcacccgcggacaagacgccaaggctgcgtacgatgcgggtgcaatctatggcggcctcatcttcgtggccacctcccctcgctgcgtgaacgttgagcaagcacaagaggtcatggccgccgcgcccctgcagtacgtgggcgtgttccgcaaccatgacattgccgatgtcgtggacaaggccaaagtgctgtccctcgcggcagtgcagctgcatggaaacgaggagcaactgtatatcgacaccctccgcgaggcccttcccgcgcatgtcgccatttggaaggccctgtcggtgggtgaaacgcttccggctcgcgagtttcaacacgtcgacaaatacgtcctggacaacgggcagggcggctcgggccagcgcttcgactggtccctgctgaacggccagtcgctgggtaatgtgttgctggcgggtgggttgggcgctgacaactgcgtcgaggcagcgcagaccggctgcgccggcctggatttcaacagcgccgtcgagagccagcccggtatcaaagacgcgcgcctgctcgcctccgtgttccagacgctgcgcgcgtat

SEQ ID NO: 50 - protein, 449 aa, Artificial sequence
  Synthetic Construct
MMQTVLAKIVADKAIWVEARKQQQPLASFQNEVQPSTRHFYDALQGARTAFICKKDSKGVIRDDFDPARIAAIYKHYASAISVLTDEKYFQGSFNFLPIVSQIAPQPILCKDFIIDPYQIYLARYYQADACLLMLSVLDDDQYRQLAAVAHSLEMGVLTEVSNEEEQERAIALGAKVVGINNRDLRDLSIDLNRTRELAPKLGHNVTVISESGINTYAQVRELSHFANGFLIGSALMAHDDLHAAVRRVLLGENKVCGLTRGQDAKAAYDAGAIYGGLIFVATSPRCVNVEQAQEVMAAAPLQYVGVFRNHDIADVVDKAKVLSLAAVQLHGNEEQLYIDTLREALPAHVAIWKALSVGETLPAREFQHVDKYVLDNGQGGSGQRFDWSLLNGQSLGNVLLAGGLGADNCVEAAQTGCAGLDFNSAVESQPGIKDARLLASVFQTLRAY

SEQ ID NO: 51 - DNA, 1398 bp, Artificial sequence
  Synthetic construct
  CDS (1)..(1398): Corynebacterium glutamicum bifunctional Indole-3-glycerol phosphate synthase/phosphoribosylanthranilate isomerase (trpF) (codon optimized)
atgacctccaataatctccccaccgttcttgaaagtatagtcgaaggccgccgcggtcatctcgaagaaatccgcgcccgcattgcccatgtcgacgtggacgcactgccgaagtcgacgcgctccctgttcgactccttgaaccaaggccgcgggggagcccggttcatcatggagtgcaaatccgacagcttgggcatgatccgcgagcactatcagccgggcgagatcgcacgggtgtactcgcgctacgcgtcgggtatctcggtgctgtgcgagcccgatcgcttcggcggagactacgatcacctggcaacggtcgcggcgacctcgcatctgccggtgctgtgcaaagacttcatcatcgatccggtgcaagtgcatgcggcccgctatttcggtgcggacgccatcctgctgatgctctccgtgctcgacgacgaagagtatgcggccgctgaggcagcgcgctttgacctggacatcctcaccgaggtcatcgatgaggaggaagtggcgcgggcgatcaagcttggcgcgaagatcttcggcgtcaaccatcggaacctccacgatctctcgattgacttggaccggtcgaggcgcctgagcaagctgattccggccgacgcagtgctggtcagcgagagcggcgtcagggacaccgagactgtccggcagcttggcggccattcgaacgccttcctcgtcggtagccaactgacctcccaggaaaacgtcgacctcgcggctcgcgagcttgtgtatgggccgaataaagtctgcggcctgaccagcccctcggcggcgcagaccgcccgggcggctggcgctgtctatggcggcctcatcttcgaggaggaccggaacgtcagccgggaaaccctgcaaaagatcatagcggccgagcccaatctccgctatgtggccgtcagtcggcgcaccagcggctacaaagatctcctggtcgacggcatcttcgccgtccagatccacgctcccctgcaggactccgttgaggccgagaaggccctcattgcggcagtgcgcgaagaggtcggtccacaggtccaggtgtggcgcgcaatctcgatgtcctccccgctcggcgccgaagtcgcggctgccgtcgagggcgacgtcgacaagctgatccttgatgcgcatgagggcggcagcggcgaggtctttgactgggccacggttccggcagcggtgaaggccaagagtctcctggccggtggcatcagccccgacaatgccgcccaagccgtcgggtgtgccggcctcgacatcaactcgggcgtggagtaccctgcgggcgccggtacgtgggcgggagcgaaagacgccggggcgctcctgaagattttcgcgacgatctcgaccttccattac

SEQ ID NO: 52 - protein, 466 aa, Artificial sequence; identical to SEQ ID NO: 44
  Synthetic Construct

SEQ ID NO: 53 - DNA, 804 bp, Artificial sequence
  Synthetic construct
  CDS (1)..(804): E. coli tryptophan synthase alpha subunit (trpA) (codon optimized)
atggaacgctatgagagtctcttcgcgcaactgaaagaaaggaaagaaggtgcatttgtcccctttgtcacgctgggcgaccccggcatcgagcagtcgctgaagatcatagacacgctgatcgaggccggggccgacgcgcttgagctcggcatccccttctccgacccgctcgccgatggccccactattcagaacgcgaccctgcgcgccttcgccgctggcgtcaccccggctcagtgcttcgagatgctggccctcatccggcagaagcatccgaccatcccgattggactgctcatgtatgcgaatctggtgttcaacaagggtatcgacgagttctacgcgcagtgcgagaaggtcggcgtggactcggtcctggtggccgacgtcccggttgaggagagcgccccattccgccaagcggcgttgcggcacaatgtcgcgccgatcttcatctgccctccgaatgccgatgacgacctcctccgccagatcgcctcgtacgggcggggctacacgtatctgcttagccgcgctggcgtgaccggcgcagagaaccgggcggctctccccttgaaccatctggtggccaagctgaaagaatacaatgccgcgcccccgctgcagggcttcggcatctccgcgccggatcaagtgaaggcagcgatcgacgcgggtgccgccggcgccatctcgggctccgccatcgtcaagattatcgagcagcacatcaacgaacccgagaaaatgctcgcggcactcaaagtgttcgtccagccgatgaaagccgcgacccgcagc

SEQ ID NO: 54 - protein, 268 aa, Artificial sequence
  Synthetic Construct
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKVFVQPMKAATRS

SEQ ID NO: 55 - DNA, 840 bp, Artificial sequence
  Synthetic construct
  CDS (1)..(840): Corynebacterium glutamicum: tryptophan synthase subunit alpha (trpA) (codon optimized)
atgtcccgctacgatgacctgtttgctcgccttgataccgctggagagggtgcctttgtcccattcattatgttgtccgatccgtcgcccgaggaagcgttccagataatctccacggccatcgaggccggtgcggacgccctcgaactgggcgttccgttcagtgaccccgtggcggacggcccgacggtcgcggagagccacctccgggcgctcgacggcggggcgaccgtcgattccgcgctggaacagatcaagcgcgtgcgggcagcataccccgaggtgccgattggcatgctcatctacgggaacgtccccttcaccaggggcctggaccggttctatcaagaattcgccgaggccggagcggactcgatcctcctgcctgacgtcccggtccgcgagggtgccccgttcagcgccgccgctgcggcagcgggcatcgaccccatctacatcgctcccgccaacgcgtcggagaaaacgcttgagggcgtgtcggcggcgtccaagggttatatctatgccatctcgcgcgacggcgtgaccggtaccgagcgcgagagcagtaccgacggcctgtccgccgtggtcgacaatatcaaaaagttcgacggcgctccgatcctgctgggcttcggcattagctcgccgcagcatgtcgccgacgcgatcgcggcaggcgcctccggggccatcacgggcagcgccatcactaagattatcgcgagccattgcgagggcgagcacccgaatccgtcgaccatccgcgacatggatggcctcaaaaaagacctcaccgagttcatctcggccatgaaagccgcgaccaaaaaggtg

SEQ ID NO: 56 - protein, 280 aa, Artificial sequence
  Synthetic Construct
MSRYDDLFARLDTAGEGAFVPFIMLSDPSPEEAFQIISTAIEAGADALELGVPFSDPVADGPTVAESHLRALDGGATVDSALEQIKRVRAAYPEVPIGMLIYGNVPFTRGLDRFYQEFAEAGADSILLPDVPVREGAPFSAAAAAAGIDPIYIAPANASEKTLEGVSAASKGYIYAISRDGVTGTERESSTDGLSAVVDNIKKFDGAPILLGFGISSPQHVADAIAAGASGAITGSAITKIIASHCEGEHPNPSTIRDMDGLKKDLTEFISAMKAATKKV

SEQ ID NO: 57 - DNA, 1167 bp, Artificial sequence
  Synthetic construct
  CDS (1)..(1167): E. coli  tryptophan synthase beta subunit (trpB) (codon optimized)
atgaccacccttctcaacccctatttcggcgaatttggcggcatgtatgttcctcagatcctgatgcccgctctgcggcaactcgaagaggccttcgtgagcgcgcagaaagaccccgagttccaggctcagttcaacgacttgctgaagaattacgcgggtcgcccaacggccctgaccaagtgccagaacatcaccgctggcacgaataccacgctctatctcaagcgcgaagatctcctgcatggtggcgcccacaagaccaaccaagtcctcggccaggccctcctggcgaagcgcatgggcaagaccgagatcatcgcggagactggagccggccagcacggcgtggccagtgcgagcgccctgctcgggctgaagtgccgcatctacatgggcgcgaaagacgtcgagcggcagtcgccgaacgtgttccggatgcggctgatgggagcagaggtcatccccgtgcattccggctcggcgacgctgaaagacgcgtgtaatgaggccctcagggattggtccggctcgtatgaaaccgcccactacatgctgggcacggccgcaggcccgcatccgtacccgaccatcgtgcgcgagtttcagcgcatgattggtgaggagactaaggcccagatacgcgagggccggctgccggacgccgtgatcgcgtgcgtcggtgggggctcgaatgcaatcggcatgttcgcggacttcattaatgaaaccaacgtcgggctgatcggcgtcgagccgggtggccacggcatcgaaaccggcgagcatggtgccccgttgaaacatggtcgcgtcggcatctatttcggcatgaaagcgccgatgatgcagaccgaggacggccaaatcgaagagagctactcgatttcggcggggctcgatttccccagcgtgggtccgcagcatgcctacctcaacagcacgggacgcgccgactatgtgtccatcaccgatgacgaggcactggaagccttcaagacgctgtgcctccacgagggcatcataccggcgcttgagtcctcccatgcccatgcgctcaagatgatgcgggagaatcccgacaaagagcaacttctcgtcgtcaacctgtcgggcaggggcgacaaagacatcttcaccgtgcatgacatcctgaagcgcgagatc

SEQ ID NO: 58 - protein, 389 aa, Artificial sequence
  Synthetic Construct
MTTLLNPYFGEFGGMYVPQILMPALRQLEEAFVSAQKDPEFQAQFNDLLKNYAGRPTALTKCQNITAGTNTTLYLKREDLLHGGAHKTNQVLGQALLAKRMGKTEIIAETGAGQHGVASASALLGLKCRIYMGAKDVERQSPNVFRMRLMGAEVIPVHSGSATLKDACNEALRDWSGSYETAHYMLGTAAGPHPYPTIVREFQRMIGEETKAQIREGRLPDAVIACVGGGSNAIGMFADFINETNVGLIGVEPGGHGIETGEHGAPLKHGRVGIYFGMKAPMMQTEDGQIEESYSISAGLDFPSVGPQHAYLNSTGRADYVSITDDEALEAFKTLCLHEGIIPALESSHAHALKMMRENPDKEQLLVVNLSGRGDKDIFTVHDILKREI

SEQ ID NO: 59 - DNA, 1245 bp, Artificial sequence
  Synthetic construct
  CDS (1)..(1245): Corynebacterium glutamicum tryptophan synthase subunit beta (trpB) (codon optimized)
atgacggaaaaagaaaatctcggcggcagcactctccttcccgcatactttggtgaatttggtggacagttcgtcgcggagtccctgctcccggcactcgaccaacttgagaaagctttcgtggatgccaccaactcgccagagttccgcgaggagttgggcggctacctccgggactaccttggacggcccacgccgctcacggaatgctcgaatctgccgctcgctggtgagggcaagggcttcgcgcggatcttcctgaagcgcgaggacctcgtgcacggtggggcgcataagaccaaccaagtgatcggccaggtcctgctggccaagcgcatgggcaagacgcggattatcgccgagactggtgccggccagcacggcacggcgaccgcctgcgcgctcatgggcttggagtgcgtcgtctacatgggcgcgaaggacgttgcgcggcagcagcctaacgtgtaccgcatgcagctccatggggccaaggtcatcccggtggagagcggctccggcaccctgaaagatgctgtcaatgaagcgctgcgcgactggaccgccaccttccatgagtcgcactatctcctgggcaccgcggctgggccgcatccgttcccgaccatcgtgcgcgagttccataaggtcatatccgaagaggccaaggcccagatgctggagcgcacgggcaagctccccgatgtcgtcgtggcctgcgttggtggcggatcgaacgcgatcggcatgttcgcggacttcatcgacgacgagggcgtggaactcgtcggggcagaaccggccggcgagggcctggatagcggcaaacacggcgcgaccatcaccaacggccagatcggcatcctgcacgggacccgcagctatctgatgcgcaattcggacggccaagtcgaggagagttattcgatctccgcgggtctggactaccccggtgtcggaccgcagcatgcgcacctccatgcaacgggccgcgcgacgtatgtgggtatcaccgacgccgaggccctgcaagcgttccagtatctggcccggtacgagggcatcatcccggcactggagtcgtcccatgccttcgcctatgccctgaagcgcgccaagaccgccgaagaggagggccagaatctgaccattctcgtgagcctctccggtaggggcgataaagacgtcgaccatgtgcgcaggaccctggaagagaaccccgagctgatcttgaaggacaaccgg

SEQ ID NO: 60 - protein, 415 aa, Artificial sequence
  Synthetic Construct
MTEKENLGGSTLLPAYFGEFGGQFVAESLLPALDQLEKAFVDATNSPEFREELGGYLRDYLGRPTPLTECSNLPLAGEGKGFARIFLKREDLVHGGAHKTNQVIGQVLLAKRMGKTRIIAETGAGQHGTATACALMGLECVVYMGAKDVARQQPNVYRMQLHGAKVIPVESGSGTLKDAVNEALRDWTATFHESHYLLGTAAGPHPFPTIVREFHKVISEEAKAQMLERTGKLPDVVVACVGGGSNAIGMFADFIDDEGVELVGAEPAGEGLDSGKHGATITNGQIGILHGTRSYLMRNSDGQVEESYSISAGLDYPGVGPQHAHLHATGRATYVGITDAEALQAFQYLARYEGIIPALESSHAFAYALKRAKTAEEEGQNLTILVSLSGRGDKDVDHVRRTLEENPELILKDNR

SEQ ID NO: 61 - DNA, 1347 bp, Artificial sequence
  Synthetic construct
  CDS (1)..(1347): E. coli strain K12 lysine-sensitive aspartokinase 3 (codon optimized)
atgtcggagattgtggtgagtaaattcgggggaactagtgtggcggattttgatgcgatgaataggagcgcggatatcgtcctgagcgacgccaacgtccggctcgtggttctctcggcctccgccggtatcacgaatcttctggtcgcgctcgccgagggcctggaaccgggcgagcgcttcgaaaaactggacgcgatccgcaatatccagttcgccatccttgagcggctgcggtatccgaatgtgatccgcgaagaaatcgagcgcctcctggagaacattaccgtccttgccgaggccgcagcgctcgccacgtcgccggctctgaccgacgagctcgtcagccacggcgagctcatgtcgacgctgttgtttgtcgagatcctccgggagcgcgacgtgcaggcgcaatggttcgacgtgcgcaaggtcatgcggacgaacgaccggttcggtcgcgcggagccggatatagcggccctggctgagctcgcagcgctgcagctccttccgcggctgaacgagggcctcgtgatcacccagggcttcatcggttcggagaataagggccgcaccaccaccctgggtaggggcggcagcgactataccgcggcgctgctggccgaggccctccacgcctcccgggtcgacatctggaccgacgtgcccggaatctacactacggatccgcgcgtggtcagcgcagcgaagcgcatcgacgagattgccttcgccgaggctgccgagatggcgaccttcggcgctaaggttctgcatcccgcgaccctcctccctgccgtgcgctccgacatccccgtgttcgtcggctccagcaaagacccacgggcggggggcaccctcgtctgcaacaagaccgagaatcccccgctgttccgcgcgctcgccctgcgccgcaaccagacgctgcttaccctccattcgctcaacatgttgcatagccgcggtttcctggccgaagtgttcggcatcctcgcgaggcacaacatctccgtggacctgatcacgacctccgaagtctccgtcgccctgaccttggacaccacgggctcgacctcgaccggggataccctgctgacgcagagcctgctcatggagctctcggcactctgccgggtcgaagtcgaggagggcctggccctcgtcgcgctcatcggcaacgacctgtcgaaggcctgcggcgtcggcaaagaggttttcggcgtgctggagccgttcaatatccgcatgatctgctacggcgcatcgtcccataacctctgtttcctcgtgccgggtgaggacgcggaacaagtcgtgcaaaagctgcattccaacctgttcgag

SEQ ID NO: 62 - protein, 449 aa, Artificial sequence
  Synthetic Construct
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFE

SEQ ID NO: 63 - DNA, 1260 bp, Artificial sequence
  Synthetic construct
  CDS (1)..(1260): Corynebacterium glutamicum  aspartokinase (codon optimized)
atggcgttggtggtgcagaaatatggggggagcagtcttgagtcggcggagaggatacggaacgttgcggagcggatcgttgcgaccaaaaaagccggcaatgatgtcgtggtcgtctgctcggcaatgggcgacaccaccgacgagctccttgagttggcagccgcggtcaacccggtgccgccagcgcgggaaatggacatgctgctgaccgcgggtgagcggatctccaacgccctcgtggccatggcgattgagtccctgggcgctgaggcgcagtcgtttacgggcagccaagcgggcgtcctgaccaccgagcgccatggcaatgcccgcatcgtcgacgtgacgcccggtcgcgtccgcgaggcactggacgagggcaagatctgcatcgtcgccggcttccagggtgtgaacaaagaaacccgcgatgtgacgaccctcggtcggggtggctcggatactaccgcggtcgccctggctgccgcgctgaacgctgacgtgtgcgagatctacagcgacgtcgacggcgtgtataccgcggatccccggatcgtgcctaacgcgcagaagctcgaaaagctgagcttcgaggagatgcttgagctggcagccgtcggcagcaagattctcgtgctccgctccgtcgagtatgccagggccttcaatgtcccgctccgcgtgcgctcgtcgtacagcaatgacccgggcacgctgatcgcgggctcgatggaggacatcccggtcgaagaggccgttctgacgggcgtcgcgaccgacaagtccgaggccaaggtcacggtgctgggcatttcggataagcccggagaggccgccaaggttttccgcgccttggccgacgccgagatcaatatcgacatggtcctgcaaaatgtgtcctccgtcgaggacggtaccaccgacatcaccttcacttgtccgcgctcggacggccgcagggcgatggaaatcctcaagaaactccaggtccagggaaactggacgaacgtgctgtacgatgaccaggtcggtaaagtctccctcgtgggcgcggggatgaagagtcatccgggcgtgaccgcagagttcatggaagcgctgcgcgacgtcaacgtgaatatcgagctcatctcgaccagcgagatccgcatctccgtcctcatacgggaagatgacctcgacgccgctgcacgcgcgctgcacgagcaattccagctcggcggcgaagatgaggccgtcgtgtacgccggcacgggc

SEQ ID NO: 64 - protein, 420 aa, Artificial sequence
  Synthetic Construct
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTG

SEQ ID NO: 65 - DNA, 1101 bp, Artificial sequence
  Synthetic construct
  CDS (1)..(1101): . coli K-12  aspartate semialdehyde dehydrogenase (codon optimized)
atgaaaaatgttggctttattgggtggcggggaatggtgggtagtgtgctgatgcagcggatggttgaggaaagggacttcgacgcgatccggcctgtgttcttctccacgtcgcagctcggccaggctgccccgtcgttcggcggcaccacgggtaccctgcaagacgccttcgatcttgaggccctgaaggccctcgatatcatcgtgacgtgtcagggtggcgactatacgaatgaaatctacccgaagctccgcgagtccggctggcagggctactggatcgacgcggcgagctcgctccggatgaaggatgacgcgatcatcattctggaccccgtgaaccaagacgtcatcaccgacggcctgaataacggcatccgcaccttcgtgggcggcaactgcaccgtgtccctgatgctcatgagcctgggcggcttgttcgcaaatgaccttgtcgactgggtgtcggtcgccacctaccaggccgctagtggtggcggagcccgccacatgcgcgagctcctcacccagatgggccacctctatggccatgtcgccgacgaactggcgaccccctcctcggcgatcctggacatcgagcgcaaggtcaccaccctcacgcgcagcggcgagctgccggtcgacaacttcggcgtcccgctcgcgggctcccttataccgtggatcgacaagcaactggataatgggcaatcgcgcgaagagtggaagggtcaggccgagactaacaagatcttgaataccagcagcgtcatccccgtggatggcctctgcgtccgggtgggtgcgctgcgctgccatagccaggccttcacgatcaagctgaaaaaagatgtctccattccgacggtcgaggaactgctcgcagcgcataacccatgggccaaagtcgtccccaacgaccgcgagatcaccatgcgggaactgaccccggcagccgtgaccggcaccctgaccacgccggtgggcaggctccgcaagctcaacatgggacccgagttcctgtcggcgttcaccgtcggcgaccagctgctgtggggggctgcggagccgctgcgccgcatgctccgccagctcgcg

SEQ ID NO: 66 - protein, 367 aa, Artificial sequence
  Synthetic Construct
MKNVGFIGWRGMVGSVLMQRMVEERDFDAIRPVFFSTSQLGQAAPSFGGTTGTLQDAFDLEALKALDIIVTCQGGDYTNEIYPKLRESGWQGYWIDAASSLRMKDDAIIILDPVNQDVITDGLNNGIRTFVGGNCTVSLMLMSLGGLFANDLVDWVSVATYQAASGGGARHMRELLTQMGHLYGHVADELATPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVEELLAAHNPWAKVVPNDREITMRELTPAAVTGTLTTPVGRLRKLNMGPEFLSAFTVGDQLLWGAAEPLRRMLRQLA

SEQ ID NO: 67 - DNA, 876 bp, Artificial sequence
  Synthetic construct
  CDS (1)..(876): E. coli F11 dihydrodipic olinate synthase (dapA) (codon optimized)
atgtttactggttccattgtcgccatcgttacccccatggatgaaaaaggtaatgtctgtcgcgcctcgctcaaaaagctgatagactatcatgtcgcgtccggcacgctcgcgatcgtcagcgtcggcaccacgggcgagagcgcaaccctgaaccatgatgagcatgccgacgtcgtgatgatgacgctggaactggcggacggccgcattcccgtgatcgcgggcaccggagccaatgccaccgccgaggccatctcgctcacccagcggttcaatgactcggggatcgtcggctgcctcaccgtgacgccgtactacaaccggccgtcccaagagggcctctatcagcatttcaaggccatcgcggagcacaccgacctcccgcagatcctgtacaacgtcccctcgcgcaccggctgcgatctccttcctgagactgtgggtcgcctcgctaaggttaagaatatcatcggcatcaaggaagcgacgggcaacctgaccagggtgaaccagatcaaagaacttgtgagtgacgacttcgtgctgctcagcggcgacgacgcctccgccctggacttcatgcagttgggcggccacggtgtgatctcggtgacggcgaacgtcgctgcgcgcgacatggcccaaatgtgcaagcttgcggcagagggacacttcgcagaggcccgcgtcatcaatcagcggctgatgccgctgcataacaagctgttcgtggagccgaacccaatcccggtgaaatgggcgtgcaaagaactgggcctcgtcgccaccgataccttgcgcctgcccatgaccccgatcaccgacagcgggcgggaaacggtccgcgctgcgctcaaacatgcgggcctgctc

SEQ ID NO: 68 - protein, 292 aa, Artificial sequence
  Synthetic Construct
MFTGSIVAIVTPMDEKGNVCRASLKKLIDYHVASGTLAIVSVGTTGESATLNHDEHADVVMMTLELADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 69 - DNA, 819 bp, Artificial sequence
  Synthetic construct
  CDS (1)..(819): E. coli K-12  dihydropdipicolinate reductase (dapB) (codon optimized)
atgcatgatgcgaatattagggtggcgatagcgggggcgggggggcggatgggaaggcagttgattcaagcggcactcgcccttgagggcgtccagctgggtgccgccctggagcgcgagggcagcagtctcctgggctcggatgccggcgagctcgctggcgcgggcaagaccggggtgacggtccagtcctcgctggatgccgtcaaagacgacttcgacgttttcatcgacttcactcgcccggaaggcaccctgaaccacctggccttttgccgccagcatggcaagggaatggtgatcggcacgacgggtttcgacgaggccggcaagcaagccatccgcgacgcagccgccgacatcgcaatcgtgttcgccgccaatttctcggtcggcgtcaatgtcatgctcaagctcctggagaaagctgccaaggtcatgggcgattataccgacatcgagattatcgaagcgcatcaccgccataaagtcgacgcgccctcgggcacggcgcttgccatgggcgaggccatcgcgcacgcgctggacaaagacctcaaggactgcgcggtgtacagccgcgagggccataccggtgagcgcgtgccgggcaccatcggcttcgccaccgtccgggcgggtgacatcgtcggagagcataccgctatgttcgcggacatcggcgagcgcctggaaatcacccacaaggccagcagccggatgaccttcgcgaacggcgcagtgcggtcggcgctgtggctgtccggtaaggaatccggcctcttcgatatgcgcgacgtgctcgatctgaacaacctc

SEQ ID NO: 70 - protein, 273 aa, Artificial sequence
  Synthetic Construct
MHDANIRVAIAGAGGRMGRQLIQAALALEGVQLGAALEREGSSLLGSDAGELAGAGKTGVTVQSSLDAVKDDFDVFIDFTRPEGTLNHLAFCRQHGKGMVIGTTGFDEAGKQAIRDAAADIAIVFAANFSVGVNVMLKLLEKAAKVMGDYTDIEIIEAHHRHKVDAPSGTALAMGEAIAHALDKDLKDCAVYSREGHTGERVPGTIGFATVRAGDIVGEHTAMFADIGERLEITHKASSRMTFANGAVRSALWLSGKESGLFDMRDVLDLNNL

SEQ ID NO: 71 - DNA, 744 bp, Artificial sequence
  Synthetic construct
  CDS (1)..(744): Corynebacterium glutamicum  dihydrodipic olinate reductase (dapB)
atgggtattaaggttggagtgttgggggcgaagggtagggtcgggcagacgatagtggcagcggtgaatgagtcggacgaccttgagctcgtggccgagattggcgtcgacgacgatctctcgctgctggtcgacaacggcgcagaagtcgtggtggacttcacgaccccgaacgctgtgatgggcaacctcgaattctgcatcaataatggcatctccgccgtggtgggtaccaccggcttcgacgatgcgcgcctggagcaagttcgcgcgtggcttgagggtaaagataatgtcggcgtcctcatcgcgccgaacttcgcgatcagcgccgtgctgaccatggtgttcagtaaacaagccgctcgctttttcgagagcgccgaggtcatcgagctccatcaccctaacaagctcgacgcgccgagcgggaccgccatccatactgcgcagggcatcgcggcggcccggaaagaggccggcatggacgcgcagccggacgcgacggaacaggccctggaaggctcgcggggagcctccgtcgacggcatcccggtgcatgctgtccgcatgtcgggcatggtcgcccacgaacaagtcatcttcggcacccagggccagaccctcacgatcaagcaagattcctacgaccggaactccttcgcacccggcgtgctggtcggcgtccgcaatatcgcccagcatcccggcctcgtcgtcggtctggagcactatctgggcctg

SEQ ID NO: 72 - protein, 248 aa, Artificial sequence; identical to SEQ ID NO: 12
  Synthetic Construct

SEQ ID NO: 73 - DNA, 1218 bp, Artificial sequence
  Synthetic construct
  CDS (1)..(1218): E. coli K12  bifunctional acetylornithine aminotransferase/succinyldiaminopimelate aminotransferase (argD) (codon optimized)
atggccattgagcaaaccgcaatcacccgcgctaccttcgacgaagttattctccccatctatgccccagcggaattcataccggtgaagggccagggctcgcggatctgggatcaacagggcaaagagtacgtggacttcgccggtggcattgccgtgacggcgctcggccattgccacccggcactggtgaacgcgctcaagacccagggcgagactttgtggcatatcagcaacgtgttcaccaatgaacccgccctgcggctggggcgcaagctgatcgaagcaacgttcgcggagcgcgtcgtgttcatgaactcgggcaccgaagccaatgaaaccgcattcaagctcgcccgccattacgcgtgcgtccgccactcccccttcaaaaccaagatcatcgcgtttcacaatgcgttccatggccggtccctgttcacggtgtcggtcggtggacagccgaagtattcggacgggttcggcccgaaaccggcggacatcatccatgtccccttcaacgatctgcacgccgttaaagccgtcatggacgaccatacgtgcgccgtggtcgtcgagccgatccagggcgagggtggcgtgacggccgccacgcctgagttcctccaagggttgcgcgagctgtgcgaccagcatcaggccctcctcgtgttcgacgaggtgcagtgtggcatgggcaggaccggcgacctgttcgcgtatatgcattacggcgtcacgccggatatcctcacctcggcgaaggccctgggtggcgggttcccgattagcgcgatgcttaccaccgccgagatcgcgtccgcgttccatccgggcagccacggcagcacctatggcggaaaccccctggcctgcgccgtcgcgggagccgctttcgatatcatcaatacccccgaggttcttgagggcatccaggcgaagcgccagcgctttgtcgaccatctccaaaagatcgaccagcagtatgacgtgtttagtgatatccggggcatgggtctgctgatcggcgcagagctcaagccgcaatacaagggtcgggccagggacttcctgtacgccggcgccgaggctggcgtgatggtcctgaacgctggccccgacgtgatgcgcttcgcgccgtccctggtcgtcgaggacgcggacatcgacgagggtatgcaacgcttcgcgcacgccgtcgcgaaagtcgtgggcgcg

SEQ ID NO: 74 - protein, 406 aa, Artificial sequence
  Synthetic Construct
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGRARDFLYAGAEAGVMVLNAGPDVMRFAPSLVVEDADIDEGMQRFAHAVAKVVGA

SEQ ID NO: 75 - DNA, 1173 bp, Artificial sequence
  Synthetic construct
  CDS (1)..(1173): Corynebacterium glutamicum (ATCC 13032)  acetylornithine aminotrasnferase (argD) (codon optimized)
atgtccacccttgaaacctggccccaagtcatcataaacacctacggcacccctccggttgagctcgtttccgggaagggtgcgacggtgaccgacgatcaaggcaatgtgtacatcgacttgctggccggcattgcggtgaatgcgctgggccacgcgcatccggcaatcatcgaagccgtcaccaatcagatcggtcagctcggccatgtgtccaacctcttcgcgtcgcggccggtcgtcgaagtggccgaggagctcattaagcgcttcagcctggacgatgccacgctcgcagcgcagacccgcgtgttcttttgtaatagtggtgccgaggccaacgaagcggcgttcaagatcgcgaggctcaccggacggtcgcggatcctggctgccgtgcacggcttccatggccgcaccatgggcagcctggcgcttacggggcagcccgataagcgcgaggcattcctgccgatgccgagcggcgtcgagttctatccctatggtgacaccgactacctccggaaaatggtcgaaacgaaccccaccgatgtggcggccatattccttgagccgatccagggtgagactggggtcgtgccggcgcccgagggcttcctgaaagccgtgcgcgagctgtgcgacgagtatggcatcctcatgattaccgatgaggtgcagacgggcgtgggccgcaccggtgacttcttcgcacatcagcacgacggcgtggtcccagacgtcgtgaccatggccaagggcctgggtggcgggctgccgatcggagcgtgcctggccacgggcagggccgctgagctcatgacgcccggaaaacatgggacgaccttcggcggcaacccggtggcctgcgcggcggcgaaagccgtcctgtcggtcgtcgacgatgccttctgcgccgaggttgcgcggaagggcgagctgttcaaagagctcctggccaaggtcgacggcgtcgtcgacgtccgcggtcgcggcctcatgctgggcgtggtcttggagcgcgacgtcgcgaagcaagccgtcctcgacggctttaagcacggcgtgatcctgaacgcaccggccgacaatatcatccgcctgacgccgccgctcgtgatcaccgacgaagaaatcgctgacgctgtcaaggccatcgcggagactatcgcg

SEQ ID NO: 76 - protein, 391 aa, Artificial sequence; identical to SEQ ID NO: 16
  Synthetic Construct

SEQ ID NO: 77 - DNA, 1125 bp, Artificial sequence
  Synthetic construct
  CDS (1)..(1125): E. coli F11 succinyl-diaminopimelate desuccinylase (dapE) (codon optimized)
atgtcgtgtcccgttatcgagctcacccaacagttgatccgccgcccctccctctcgcctgatgacgccggttgccaggccctcctgatcgagcgcctgcaagcgatagggttcaccgtggagcgcatggacttcgcggacacccagaatttctgggcgtggcggggtcagggcgaaacgctggccttcgcgggccacaccgacgtcgtcccaccgggtgacgccgaccgctggatcaatccgccgttcgagccgacgatccgcgacggcatgcttttcggcaggggagccgctgacatgaagggcagcctggcggcgatggtcgtcgcagccgagcggttcgtggcgcagcatccgaatcacacgggtcggctcgcattcctgattacctccgatgaagaggcctcggcgcataatgggaccgtgaaagtcgtcgaggccctgatggcgcggaacgagcgcctggactattgcctggtgggcgagcccagctccatcgaagtcgtgggcgacgttgtgaaaaacggccgccggggcagtctcacgtgcaacctcacgattcatggcgtgcagggccacgtcgcgtatccgcatctggcggataaccccgtccatcgcgcagcaccgtttatcaacgagctcgtggccatcgagtgggatcagggcaacgaattcttccccgccacctcgatgcagatcgctaatatccaggccggtaccggctcgaacaacgtcattccgggcgagttgttcgtgcagttcaatttccgcttcagcaccgagctgaccgacgagatgatcaaagaacaagtcctggctctcctggagaagcatcagctgcggtacaccgtggactggtggctcagcggccagccgtttctgacggcgaggggcaagcttgtcgatgccgtcgtgaacgccgtggagcattacaatgagatcaagccgcagctcctcaccactggtggcacgtccgacggccgcttcatcgcgcggatgggagcgcaagtcgtcgagcttgggccggtgaacgcgaccatccacaagatcaacgaatgcgtgaatgccgccgacctccagctgctggctcgcatgtaccagcgcatcatggaacaactcgtcgcg

SEQ ID NO: 78 - protein, 375 aa, Artificial sequence
  Synthetic Construct
MSCPVIELTQQLIRRPSLSPDDAGCQALLIERLQAIGFTVERMDFADTQNFWAWRGQGETLAFAGHTDVVPPGDADRWINPPFEPTIRDGMLFGRGAADMKGSLAAMVVAAERFVAQHPNHTGRLAFLITSDEEASAHNGTVKVVEALMARNERLDYCLVGEPSSIEVVGDVVKNGRRGSLTCNLTIHGVQGHVAYPHLADNPVHRAAPFINELVAIEWDQGNEFFPATSMQIANIQAGTGSNNVIPGELFVQFNFRFSTELTDEMIKEQVLALLEKHQLRYTVDWWLSGQPFLTARGKLVDAVVNAVEHYNEIKPQLLTTGGTSDGRFIARMGAQVVELGPVNATIHKINECVNAADLQLLARMYQRIMEQLVA

SEQ ID NO: 79 - DNA, 822 bp, Artificial sequence
  Synthetic construct
  CDS (1)..(822): Corynebacterium glutamicum succinyldiaminopimelate desuccinylase (dapE) (Acc. No. CAA57141.1) (codon optimized)
atgcaattctcgaaaatgcacggacttggcaatgattttatggtggtggacgcagttacgcagaacgtctttttctcccccgagctcatcaggcgcctcgccgatcgccatctgggcgtgggcttcgaccagctcctcgtcgtggagccaccgtatgaccccgagctggatttccactaccgcatcttcaacgctgacggcagcgaagtcgcgcagtgcggcaatggtgcgcggtgcttcgcccggttcgtccgcctcaagggcctgaccaataagcgcgacatccgggtcagcaccgccaacggccgcatggtgctgaccgtcaccgacgacgacttggtgcgcgtcaacatgggcgagccgaatttcgagccgtccgccgtccctttccgcgcgaacaaagccgaaaagacctatatcatgcgggcagcggagcagacgattctctgcggcgttgtctcgatggggaacccccattgcgtcatccaggtcgacgacgtggataccgctgcggtcgaaacgcttggcccggtgctggagagtcacgagcggttcccggagagggccaacatcggcttcatgcaagtcgtgaagcgcgagcatatccggctgcgcgtgtacgagcgcggggcgggcgagactcaggcgtgcggctcgggtgcgtgtgccgccgtggccgttggcatccagcaagggctcctggccgaagaggtgcgcgtcgagctgcccggtggccggctggacattgcgtggaagggaccgggccatccgctgtatatgaccggtccggccgtgcatgtctacgacggcttcatacacctc

SEQ ID NO: 80 - protein, 274 aa, Artificial sequence; identical to SEQ ID NO: 20
  Synthetic Construct

SEQ ID NO: 81 - DNA, 831 bp, Artificial sequence
  Synthetic construct
  CDS (1)..(831): Corynebacterium glutamicum (ATCC 13032) diaminopimelate epimerase (dapF) (codon optimized)
atgaacctgaccatcccgttcgccaagggccatgcaaccgagaatgacttcataattatccccgacgaagatgcgcgccttgatctgacgccggaaatggtcgtgaccctgtgcgaccgcagggccggaatcggcgctgacggcatcctgcgggtcgttaaagccgccgatgtcgagggttcgaccgtggacccctccctctggttcatggactatcggaatgccgacggctccctggccgagatgtgcggcaacggcgtccgcctgttcgcgcattggctttacagtcgggggctcgtggacaatacctccttcgacatcggtacccgcgcaggcgtgcgccacgtggacattctccaagccgatcagcatagcgcccaggtgcgcgtggatatgggcatcccagacgtgacgggactctcgacgtgcgacatcaacggtcaggtttttgcggggctgggcgtcgacatgggcaacccgcacctcgcctgcgtggtccctggcctgtcggcctccgcgttggcggacatggaactgcgcgcacccaccttcgaccaagagttcttcccgcatggcgtcaacgtcgagatcgtgaccgagctcgaagatgacgctgtcagcatgcgggtttgggagcggggtgtcggcgaaacgcgcagctgcggaaccggcactgtggcggctgcgtgtgcggcgctcgcggacgcgggtctgggcgagggcacggtcaaggtctgcgtcccgggtggcgaggtcgaagtccagatcttcgacgacggcagcaccctcaccgggccgtcggcgatcatcgccctgggcgaggtgcagatc

SEQ ID NO: 82 - protein, 277 aa, Artificial sequence
  Synthetic Construct
MNLTIPFAKGHATENDFIIIPDEDARLDLTPEMVVTLCDRRAGIGADGILRVVKAADVEGSTVDPSLWFMDYRNADGSLAEMCGNGVRLFAHWLYSRGLVDNTSFDIGTRAGVRHVDILQADQHSAQVRVDMGIPDVTGLSTCDINGQVFAGLGVDMGNPHLACVVPGLSASALADMELRAPTFDQEFFPHGVNVEIVTELEDDAVSMRVWERGVGETRSCGTGTVAAACAALADAGLGEGTVKVCVPGGEVEVQIFDDGSTLTGPSAIIALGEVQI

SEQ ID NO: 83 - DNA, 1260 bp, Artificial sequence
  Synthetic construct
  CDS (1)..(1260): E. coli K-12 diaminopimelate (lysA) (Acc. No. AAB40485.1) (codon optimized)
atgccgcattccctcttctccaccgacaccgacctgaccgccgagaacctcctgcgcctgcctgccgagtttggctgccccgtttgggtgtatgatgcgcagatcattcgccgccagatcgccgcgctgaagcagttcgatgtcgtccgcttcgcccagaaagcgtgcagcaatatccatatcttgcggctcatgcgggagcagggcgtcaaagtcgactcggtgtcgctcggcgagatcgagcgcgcactggccgcagggtataatccgcagacccacccggacgacatagtgttcaccgctgacgtcatcgaccaggcgaccctcgaacgggtgtccgagctgcaaatccccgtcaatgccggctcggtggacatgcttgatcagctgggccaggtgtcccccggtcatcgggtctggctccgcgtgaacccgggcttcgggcacggccattcgcaaaagaccaacacgggtggcgagaatagcaaacatggcatctggtatacggatctgccggcggcgctcgatgtcatccagcggcatcatctgcagctcgtcggcattcacatgcatatcgggtccggtgtggattatgcacatctggagcaagtgtgtggagcgatggtccgccaggtcatcgagttcggccaagacctccaggccattagtgccggcgggggactctcggtgccgtaccaacagggtgaggaagctgtcgacaccgagcattactacggcctctggaatgccgctcgcgagcaaatcgccaggcaccttggccacccggtgaagctcgaaatcgagccgggtcggttcctggtggcccagagcggcgtcctcatcacgcaagtgcggtcggtcaagcagatgggctcgcgccacttcgtcctggtggacgcgggattcaacgacctgatgcgcccagccatgtacggcagctaccatcacatatccgcgcttgccgccgacggccggtcgctggagcatgcgccgaccgttgaaaccgtcgtggcaggccccctgtgcgagtccggcgacgttttcacgcagcaagagggcggcaacgtcgagactcgcgcgctccccgaggtcaaggctggggactatctggtgttgcacgacacgggtgcgtacggcgcctcgatgagcagcaactacaacagtcgcccgttgctccccgaagtcctgttcgacaacggccaggcgaggctgatccgccgcaggcagaccatcgaggagctgctcgcgctcgaactcctg

SEQ ID NO: 84 - protein, 420 aa, Artificial sequence
  Synthetic Construct
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 85 - DNA, 1335 bp, Artificial sequence
  Synthetic construct
  CDS (1)..(1335): Corynebacterium glutamicum (ATCC 13032) diaminopimelate decarboxylase (lysA) (codon optimized)
atggcaacggtcgaaaactttaatgaactccccgcacacgtttggcccaggaacgcagtcaggcaagaggatggtgttgtgaccgttgcgggcgtcccgctgccggacctggccgaggaatatggcacgccgctgttcgtcgtggacgaggacgactttcggagccgctgccgcgatatggccactgcgttcggcggacccggcaacgtccattatgcctccaaagcgttcctgaccaaaaccatcgcgcggtgggtcgacgaggagggcctggccctggatatcgcgtccatcaacgagctgggaattgcccttgccgctggcttccccgccagccgcatcacggcccacggcaacaacaaaggcgtggaattcctcagggcgctggtgcagaacggcgtcggacatgtcgtcctcgactccgcccaggagcttgagctcctcgattatgtcgccgccggcgagggtaagatccaggacgtgctgatccgggtgaagcctgggatagaggcacatacccatgaattcatcgccacctcgcacgaagatcaaaagttcgggttctccctcgcgagcggttccgcgttcgaggccgcgaaggccgccaataatgctgagaatcttaatctcgtcgggctccattgccatgtcgggagccaagtgttcgacgccgagggcttcaagctcgctgcggagcgcgtgttgggtctgtacagtcagatccacagcgagctcggcgtggcgctgcccgagctggacctgggcggcgggtacggcatcgcgtatacggctgctgaggaaccgctgaacgtcgccgaggtcgcgagtgacctcctgaccgccgtgggcaagatggccgcagagttgggcatcgacgccccgacggtcctcgtggagccgggtcgggcgattgctggcccgtcgactgtgaccatctacgaggtcggcaccaccaaagacgtgcatgtggacgatgacaagacccggcgctatatcgccgtggacggtggcatgtccgacaacatccgcccagccctgtacggcagcgagtacgatgcgcgggtcgtgtcgcgcttcgccgagggtgacccggtgtccacccggatcgtcggctcgcactgcgagtccggcgacatcctcatcaatgacgagatctacccgtcggacatcacctcgggcgacttcctcgcgctggcggcgacgggcgcgtactgctatgcgatgtcgtcgcgctacaatgcgttcacccgccccgcggtcgtgagcgtccgcgcaggctcctcccgcctgatgcttcgccgcgaaaccctggacgatattctgtcgctcgaagcc

SEQ ID NO: 86 - protein, 445 aa, Artificial sequence
  Synthetic Construct
MATVENFNELPAHVWPRNAVRQEDGVVTVAGVPLPDLAEEYGTPLFVVDEDDFRSRCRDMATAFGGPGNVHYASKAFLTKTIARWVDEEGLALDIASINELGIALAAGFPASRITAHGNNKGVEFLRALVQNGVGHVVLDSAQELELLDYVAAGEGKIQDVLIRVKPGIEAHTHEFIATSHEDQKFGFSLASGSAFEAAKAANNAENLNLVGLHCHVGSQVFDAEGFKLAAERVLGLYSQIHSELGVALPELDLGGGYGIAYTAAEEPLNVAEVASDLLTAVGKMAAELGIDAPTVLVEPGRAIAGPSTVTIYEVGTTKDVHVDDDKTRRYIAVDGGMSDNIRPALYGSEYDARVVSRFAEGDPVSTRIVGSHCESGDILINDEIYPSDITSGDFLALAATGAYCYAMSSRYNAFTRPAVVSVRAGSSRLMLRRETLDDILSLEA

SEQ ID NO: 87 - DNA, 495 bp, Artificial sequence
  Synthetic construct
  CDS (1)..(495): E. coli K-12 chorismatae pyruvate lyase (Acc. No. YP_492182.1) (codon optimized)
atgtcgcatcccgcactcacccaacttcgcgccctccgctattgcaaagaaatcccggctttggacccgcagctgctcgactggctcctgcttgaggactccatgacgaagcgctttgagcaacagggcaagaccgtgtccgtgacgatgatccgcgagggcttcgtcgagcagaacgaaatccctgaggagctgcccctcctgccgaaggaaagccgctactggttgcgcgagatcctcctctgcgcggacggcgagccgtggctggcgggcaggactgtcgtgccagtctcgacgctgagcggtcccgagctcgcgctgcagaaactcggcaagaccccgctgggtcggtacctgttcaccagttccaccctcacccgggatttcatcgagattggccgggatgccggcctgtggggacggcgctcgcggctgcgcctgagcgggaagccgctcctgctgaccgagctgttcctccccgcctcgccgctgtat

SEQ ID NO: 88 - protein, 165 aa, Artificial sequence
  Synthetic Construct
MSHPALTQLRALRYCKEIPALDPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPASPLY

SEQ ID NO: 89 - DNA, 1560 bp, Artificial sequence
  Synthetic construct
  CDS (1)..(1560): E. coli anthranilate synthase component I (Acc. No. AAA57297.1) (codon optimized)
atgcaaacccaaaagccgaccctggaactcctcacgtgtgaaggcgcctaccgcgacaatccgaccgccctgttccatcaattgtgcggcgatcggcccgcgaccctgcttttggagtccgccgacattgacagcaaggacgacctcaagtcgctcctcctcgtcgactccgcgctccggatcacggccctgggcgacacggtcaccattcaggccctcagtggtaacggcgaggcactgctcgccctgctggacaacgcgctgccggctggcgtcgagagcgagcagagcccgaattgccgggtgcttcgcttccctcccgtgtcgccgctgctcgacgaggatgcgcgcctgtgctcgctgagcgtctttgacgcgttccgcctgctgcagaacctcctgaacgtgccgaaagaagaacgcgaggccatgttcttctccggactgttctcgtacgatctggtggccggcttcgaggatctcccgcagctcagtgcggagaataactgccctgatttctgcttctatctcgccgaaaccttgatggtcatcgaccatcagaaaaagtcgacccgcatccaggctagtctgttcgccccgaatgaggaggagaagcagcggttgacggcgaggctcaacgagctccggcagcaactgaccgaagccgcgccgccgctgccagtggtgtcggtgccgcacatgcgctgcgagtgcaaccagtcggacgaagagtttggtggcgtcgtccgcctgctccaaaaggccatcagggccggagagatcttccaggtcgtcccctcgcggcgcttctcgctgccgtgcccgtccccgctcgcggcatattacgtcctgaagaaatcgaacccctccccctacatgtttttcatgcaagacaatgatttcacgctgttcggcgcgtccccggagtcgtcgctcaaatacgacgcgaccagccgccagatcgagatctatccgatcgcgggcacccggccacggggccgccgcgcggacgggagcctggacagggacctcgatagccgcatcgagcttgagatgcgcaccgatcataaagagctgtcggagcacctgatgctggtcgatctcgctcgcaatgacctggcgcgcatctgcacccccggtagccgctacgtcgccgacctcaccaaagtcgaccgctacagctatgttatgcacctggtgtcccgggttgtcggcgagctgcgccatgacctggacgccctccacgcgtatcgcgcgtgcatgaacatggggaccctctccggagcgcccaaggttcgggccatgcagctgatcgccgaggcagagggcaggcgccgcggctcgtacgggggcgcggtgggttatttcacggcccatggtgacctcgacacgtgcatcgtgattcggagcgccctcgtggagaatggcatcgcgaccgtgcaggctggcgcaggcgtggtgcttgactccgtcccccagtccgaggccgacgagactcgcaacaaagctcgggccgtgctgcgcgcgatagcaaccgcgcatcacgcccaggaaacgttc

SEQ ID NO: 90 - protein, 520 aa, Artificial sequence
  Synthetic Construct
MQTQKPTLELLTCEGAYRDNPTALFHQLCGDRPATLLLESADIDSKDDLKSLLLVDSALRITALGDTVTIQALSGNGEALLALLDNALPAGVESEQSPNCRVLRFPPVSPLLDEDARLCSLSVFDAFRLLQNLLNVPKEEREAMFFSGLFSYDLVAGFEDLPQLSAENNCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 91 - DNA, 1554 bp, Artificial sequence
  Synthetic construct
  CDS (1)..(1554): Corynebacterium glutamicum anthranilate synthase component 1 (trpE) (Acc. No. CAA39467) (codon optimized)
atgtccaccaatccccacgtgttctccctcgacgtgcgctatcatgaagatgcatccgcgctgtttgcccatctgggcggcactaccgcggacgatgcggcgctgctggagtccgcggacatcacgaccaaaaacggcattagttcgctggccgtgttgaagtccagtgtccgcatcacgtgcaccggcaataccgtggtgacgcagccgctcaccgatagcggtcgcgccgtcgtggcacgcctcacgcagcaactcggccagtacaacacggccgagaacaccttttcgttccccgcgtcggacgccgtggatgagcgggagaggctcacggctccgtcgaccatcgaggtccttcgcaagctgcaattcgagtcgggctattccgacgcgagcctcccgctcctgatgggcggcttcgcgttcgacttcctggaaaccttcgagactctccccgctgttgaggagtccgtcaatacctatccggactaccagttcgtcctggccgagatcgtcctggatatcaatcaccaggaccagacggccaagcttaccggcgtgagcaatgcaccgggtgagttggaagccgagctcaataagctctcgctcctgatagacgcagcgctgcctgcgaccgagcatgcgtaccagacgaccccgcacgacggggacacgctgcgggtcgtcgccgacatcccggacgcgcagttccggacccagatcaatgagctgaaagagaacatttacaacggcgacatctaccaagtcgtcccggctcgcacgttcaccgccccatgcccggatgcgttcgcggcctacctccagctccgcgcgacgaaccctagcccgtacatgttctatatcaggggactcaacgagggccgctcgtacgagctgttcggcgccagcccggagagtaacctgaaattcacggcagcaaaccgcgagctccagctctaccccatcgccggcacccgcccacgcggcctgaatccggacggttcgatcaatgacgagctggacatccggaacgaactggatatgcgcaccgacgccaaagaaattgcagacgacaccatgcttgtggacctcgcgcggaatgacctggcccgggtgtcggtgcccgcgagccgccgcgtcgccgacctcctgcaagtcgaccgctattcccgcgtgatgcatctcgtcagccgcgtgaccgcgaccctcgacccggaactggacgcgctcgatgcgtatcgggcgtgcatgaacatggggaccctcaccggtgccccgaagctgcgggcgatggagttgttgcggggcgttgagaagcgccggcgcggcagctatggcggagccgtcggctacctgaggggcaatggtgacatggataactgcatcgtcatccggtccgcgttcgtccaggacggtgtggcggctgtgcaggccggggcgggcgtggtgcgcgattcgaacccccaaagcgaagcggacgaaaccctgcataaggcctatgccgtcctgaacgccatcgctctggccgccggctcgacccttgaggtcatccgc

SEQ ID NO: 92 - protein, 518 aa, Artificial sequence
  Synthetic Construct
MSTNPHVFSLDVRYHEDASALFAHLGGTTADDAALLESADITTKNGISSLAVLKSSVRITCTGNTVVTQPLTDSGRAVVARLTQQLGQYNTAENTFSFPASDAVDERERLTAPSTIEVLRKLQFESGYSDASLPLLMGGFAFDFLETFETLPAVEESVNTYPDYQFVLAEIVLDINHQDQTAKLTGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRGLNEGRSYELFGASPESNLKFTAANRELQLYPIAGTRPRGLNPDGSINDELDIRNELDMRTDAKEIADDTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVIR

SEQ ID NO: 93 - DNA, 1593 bp, Artificial sequence
  Synthetic construct
  CDS (1)..(1593): E. coli anthranilate synthase (trpC) anthranilate synthase component II (codon optimized)
atggccgacatcctgctcctcgacaacatcgactcgttcacctacaacctcgccgaccaactgcgctcgaacgggcacaatgtcgtgatataccgcaatcatatcccggctcagaccttgatcgagcgcctggcgaccatgagcaatccggttctgatgctgtcgcccggtccgggcgtcccctccgaggctgggtgcatgcccgagctcctgaccaggctgcggggcaaactgccgatcattggcatctgcctcggacaccaagcgatcgtcgaggcctatggcggctacgtgggccaggccggcgagattctgcatgggaaggcctcctccatcgagcacgacggccaggcaatgttcgcgggtctgacgaacccgctcccggtcgcgcgctaccactcgctggtcggctcgaatatcccggcaggcctgaccatcaatgcgcacttcaacggcatggtgatggcagtgcggcatgacgccgaccgcgtctgcggtttccagtttcatcctgagtccatcttgaccacccagggtgcgcggttgctggagcaaacgctggcctgggcgcaacataagctcgaaccggcgaacacgctccagccgatcctggagaaactttatcaggcgcagaccctcagccagcaagagtcccatcagctgttcagcgcggtcgtccgcggcgagctcaaaccggaacagctcgctgccgcgctcgtcagcatgaagatacgcggggagcaccccaatgagatcgctggcgcggccaccgcgctgctggagaacgccgcaccgttccctcgcccggactatctgtttgccgacatcgtcggcaccggtggcgacggttcgaatagcatcaacatctccacggcgtccgcgttcgtggccgcagcgtgcggcctcaaagtcgccaaacatggcaatcgctccgtgtcgtccaagagtggcagctcggacctgttggcggcgttcgggatcaacctcgacatgaatgccgacaagagccgccaagcgctcgatgagcttggcgtgtgcttcctgttcgcgccaaagtaccatacgggcttccggcacgccatgccggtgcggcagcaactcaagacccgcaccctgttcaacgttcttggacccctgattaacccggcgcatcccccgctcgcgctcatcggtgtgtactcgcccgagctcgtcctcccgatcgcagagactctccgcgtcctgggctatcagagggctgccgtggtgcatagcggcggaatggacgaggtttcgcttcatgccccaaccatcgtggccgagctccatgacggcgagatcaagtcctaccagctgactgccgaagatttcggcctcacgccctatcatcaggaacagctggccggtggcacccccgaggaaaaccgggatatcctgacgcgcttgctgcagggcaagggcgacgcagcgcatgaagccgccgtggccgcgaacgtcgccatgctcatgcgccttcacggtcacgaagatctgcaggcgaacgcccaaaccgtcctcgaagtcctccgcagtggctcggcctatgatcgggtcacggccctggcggctaggggc

SEQ ID NO: 94 - protein, 531 aa, Artificial sequence
  Synthetic Construct
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQHKLEPANTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 95 - DNA, 624 bp, Artificial sequence
  Synthetic construct
  CDS (1)..(624): E. coli  W  anthranilate phosphoribosyl transferase (Acc. No. ADT74841.1) (codon optimized)
atgacccacgtcgtcctcattgataatcatgactcctttgtgtacaacctcgttgatgccttcgccgtcgccggctataagtgcacggtgttccgcaacacggtgccggtcgaaaccattctggccgcgaacccggacctcatctgcctcagcccgggaccgggctatcccgcggacgcggggaacatgatggccctgatcgagcggaccttgggccagatccccctgcttggtatctgtcttgggtatcaggccctcatcgagtaccacggcggcaaagtcgagccgtgcggcccagtgcacggcaccacggacaatatgatcctgaccgatgcgggcgtccaaagcccggtgttcgcgggtctggccaccgacgtcgagccggaccatcctgagatcccgggacgcaaggtccccatcggtcggtaccattcgctgggctgcgtggtggcacccgacggcatcgagtcgctcggcacgtgctccagcgagatcggcgacgtgatcatggctgcgaggaccactgacggcaaggcaatcggcctgcagttccatcccgagagtgtcctgtcgccgaccggtccggtcatactctcccgctgcgtggaacagctcctggcgaat

SEQ ID NO: 96 - protein, 208 aa, Artificial sequence; identical to SEQ ID NO: 36
  Synthetic Construct

SEQ ID NO: 97 - DNA, 1593 bp, Artificial sequence
  Synthetic construct
  CDS (1)..(1593): E. coli W anthranilate phosphoribosyl transferase (trpD) (codon optimized)
atggccgacatcctcctgcttgacaatatcgactccttcacctataatcttgctgatcagctgcgctcgaatggccataacgtcgtcatctaccgcaaccatatccctgcgcagacgctgatcgagcgcctggcgactatgagcaaccccgtgctgatgctgtccccgggtccgggagtgccctccgaggccggctgcatgcccgagctcttgacccgcctccgcggcaagctcccgatcatcggcatttgcctgggccaccaagcgatcgtcgaggcgtacggcgggtatgtcggtcaggccggtgagatcctccacggcaaggccagttccatcgagcatgatggccaagccatgtttgcgggcctcacgaatccgctcccggtggcgcgctatcatagcctggttggctcgaacatccccgctggcctcacgatcaacgcgcatttcaacgggatggtcatggcagtccggcatgacgccgaccgcgtctgcggtttccagttccacccggagagcattctgaccacccagggcgcacggctcttggagcaaaccctggcctgggcccagcagaaactggagccggccaacacgctgcagcccatcctcgaaaagctttatcaggcgcagaccctctcgcaacaggaaagtcatcagctgttctccgcagtggtcaggggcgagctgaagcccgagcaactcgcggctgccctggtgagcatgaaaatacgcggggagcatcccaatgagatcgcgggagcggcgaccgcgctgctggagaatgccgctccgtttccacggccggactacctcttcgcggacatcgtcgggaccggtggcgacggcagcaacagcatcaacatctcgacggcgagcgcattcgtcgcagcggcgtgtggcctcaaagtcgcgaagcacggcaaccggtccgtgtcgtccaagtccggttcctcggatcttctcgcggccttcggcattaacctggatatgaatgccgacaagtcgcgccaggccctcgacgagctgggcgtgtgcttcttgttcgcccccaagtatcacacgggcttccgccacgcgatgccggtccgccaacagctgaaaacccggacgctgttcaacgtcctcggtccgctgataaatccggcgcatccgcccctggccctgattggcgtgtacagcccagagctcgtcctgccgatcgcagaaacccttcgggtcctgggctatcaacgcgctgccgtggtgcattcgggcggaatggacgaagtgtcgctccacgcgcctaccatcgtcgccgagctgcatgacggcgagatcaagtcgtaccagctcactgccgaggacttcggcctgaccccgtaccatcaggaacaactcgcgggcggcaccccggaagagaatcgggacatcctcacccgcctcctgcagggtaagggcgatgcggcgcacgaagccgccgtggcggccaatgttgcgatgctgatgcggctgcatggccacgaagatttgcaggcgaacgcgcagaccgtgctcgaagtgctccgctcggggagcgcttacgaccgcgtcacggccctcgccgccaggggc

SEQ ID NO: 98 - protein, 531 aa, Artificial sequence
  Synthetic Construct
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPANTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 99 - DNA, 1044 bp, Artificial sequence
  Synthetic construct
  CDS (1)..(1044): Corynebacterium glutamicum (ATCC 13032)  anthranilate phosphoribosyl transferase (codon optimized)
atgactagccctgccacgctcaaagtgctgaatgcctacctcgacaatcccacccccaccctggaagaagccattgaagtgttcacgccgctgaccgtgggcgagtacgacgacgtccacatcgcggcactgctggcgacgatacgcacccgcggtgagcaatttgcggacatcgcgggagccgcaaaggccttccttgctgccgccaggccattcccgatcaccggcgccggcctgctggactcggcgggtaccggtggcgacggcgcgaataccatcaacatcaccaccggtgcgagcctgatcgcggcctcgggcggagtcaagctcgtgaagcatggtaaccgcagcgtttcgtcgaagtccggctcggccgacgtccttgaggccctgaacatccccctcggcctcgacgtggatcgcgcggtcaagtggtttgaggcctccaacttcaccttcctcttcgcgccggcgtacaacccggcgatcgcccatgtccagcccgtgcggcaagcgctcaagttcccgaccatcttcaacacgctcggcccgttgctgagtccggcacggcccgagcggcagatcatgggcgtcgccaacgccaatcacggccagctcattgccgaggttttccgcgagctcggccggacgcgcgctctggtcgtccatggggcagggactgatgagatcgccgtgcatggcaccaccctggtgtgggaactgaaagaggatggcaccatcgagcattataccatcgagccggaagatctcggcctggggcgctatacccttgaggatctcgtcggcggcctgggcaccgagaatgcagaggccatgcgggcgacgttcgcgggtacgggtccggacgcccaccgcgacgctctcgccgcgtccgctggcgcgatgttctacttgaatggcgacgtggactccctgaaggacggcgcgcagaaagcgctgtcgctcctcgcggacggcacgacccaggcctggctggcgaaacatgaagagatcgactatagcgagaaagagagctccaacgac

SEQ ID NO: 100 - protein, 348 aa, Artificial sequence
  Synthetic Construct
MTSPATLKVLNAYLDNPTPTLEEAIEVFTPLTVGEYDDVHIAALLATIRTRGEQFADIAGAAKAFLAAARPFPITGAGLLDSAGTGGDGANTINITTGASLIAASGGVKLVKHGNRSVSSKSGSADVLEALNIPLGLDVDRAVKWFEASNFTFLFAPAYNPAIAHVQPVRQALKFPTIFNTLGPLLSPARPERQIMGVANANHGQLIAEVFRELGRTRALVVHGAGTDEIAVHGTTLVWELKEDGTIEHYTIEPEDLGLGRYTLEDLVGGLGTENAEAMRATFAGTGPDAHRDALAASAGAMFYLNGDVDSLKDGAQKALSLLADGTTQAWLAKHEEIDYSEKESSND

SEQ ID NO: 101 - DNA, 1356 bp, Artificial sequence
  Synthetic construct
  CDS (1)..(1356): E.coli anthranilate isomerase (trpC) (codon optimized)
atgcaaaccgtcctcgccaaaatcgtcgcagataaagctatatgggttgaagcgcgcaaacaacaacaaccgctcgcgtccttccagaacgaagtccagccctccacccgccacttctacgacgcgctccagggtgcccggaccgccttcatcctggagtgcaagaaggcctcgccgagcaagggcgtcatccgggacgatttcgacccggcgaggatcgcggccatctacaagcattatgcgtccgcgatctccgtgctgaccgatgagaagtacttccggggctcgttcaacttcctgccgattgtctcgcagatcgccccgcagcccatactgtgcaaagatttcatcatcgacccgtatcagatctatctggcgcgctactatcaggcagacgcctgcctgctgatgctgagcgtgctggacgacgaccagtaccgccagctggctgcggtggcgcacagccttgagatgggcgtgctcaccgaagtcagcaacgaagaggagcaggagcgcgccatcgcgctcggggctaaagttgtgggcatcaataaccgcgacctccgggacctgtcgatcgatcttaatcgcacccgcgagcttgcgccgaaactgggccataatgtgaccgtgattagtgagtccggaattaacacgtatgcccaggtccgcgagctttcccatttcgccaacggctttttgatcgggtcggccctgatggcccatgacgatctccacgcggctgtgcggcgcgtcctgttgggcgagaataaggtctgcggtctgactcgcggccaagacgcgaaggccgcgtatgacgcgggtgcaatctatggtggcctcatctttgtcgccacgtcccccaggtgcgtcaacgtcgagcaagcgcaggaagttatggcagccgcccccctgcagtacgtcggcgtgttccggaatcacgacatcgctgacgtggtcgacaaggccaaggtcctctcgctcgtcgccgtgcagctgcatgggaacgaggaacaactgtacatcgacacgctccgcgaggcgctgcctgcgcatgtggcgatctggaaggccctgagcgtcggcgaaaccctcccagcgcgcgagttccaacatgtggacaagtatgtcctcgacaacggccagggcggctcgggccagcggttcgactggagcctgctcaacggccagaccctgggcaacgtgctgctcgcgggtggactcggggctgataattgtgtcgaggccgcccagacgggctgcgcgggactggacttcaattccgccgtggagtcgcagcccggcattaaagatgcccgcctcttggcaagcgtgttccagaccctccgggcgtac

SEQ ID NO: 102 - protein, 452 aa, Artificial sequence
  Synthetic Construct
MQTVLAKIVADKAIWVEARKQQQPLASFQNEVQPSTRHFYDALQGARTAFILECKKASPSKGVIRDDFDPARIAAIYKHYASAISVLTDEKYFRGSFNFLPIVSQIAPQPILCKDFIIDPYQIYLARYYQADACLLMLSVLDDDQYRQLAAVAHSLEMGVLTEVSNEEEQERAIALGAKVVGINNRDLRDLSIDLNRTRELAPKLGHNVTVISESGINTYAQVRELSHFANGFLIGSALMAHDDLHAAVRRVLLGENKVCGLTRGQDAKAAYDAGAIYGGLIFVATSPRCVNVEQAQEVMAAAPLQYVGVFRNHDIADVVDKAKVLSLVAVQLHGNEEQLYIDTLREALPAHVAIWKALSVGETLPAREFQHVDKYVLDNGQGGSGQRFDWSLLNGQTLGNVLLAGGLGADNCVEAAQTGCAGLDFNSAVESQPGIKDARLLASVFQTLRAY

SEQ ID NO: 103 - DNA, 1422 bp, Artificial sequence
  Synthetic construct
  CDS (1)..(1422): Corynebacterium glutamicum (ATCC 13032)  indole-3-glycerol phosphate synthase/phosphoribosylanthranilate isomerase (trpC) (codon optimized)
atgaccagcaacaatcttccaaccgttctcgaatccatagttgaaggccgccgcggacaccttgaagagatccgcgcgaggatcgcgcacgtcgacgtcgacgccctcccgaagtccacccgctccctgttcgattcgctcaatcaaggccggggcggcgcacggttcatcatggagtgcaagagtgcgagcccgtccttgggcatgatccgggagcactatcagcccggcgagatcgcgcgcgtctactcccgctacgcatcgggcattagcgtgctgtgcgagccggataggttcggcggcgactacgaccatctggccaccgtcgccgccacgagccatctgccggtgctctgcaaagactttatcatcgacccggtccaggtgcatgccgcgcggtacttcggtgcggatgctattctgctgatgctctcggtgcttgatgacgaggaatacgccgcactggcggcagaggcagcgcggttcgatctcgacatcctgaccgaagtcatcgacgaagaggaagtggcgagggcgatcaagctcggggccaagatcttcggcgtcaaccaccgcaacctccatgacctgtccatcgacctcgaccggagtcgccgcctgagcaagctcattccggccgatgctgtgctggtgagcgagtccggcgtccgggatacggagactgtccgccagctcggtggccattccaatgcctttctggtgggcagtcaactcacgagccaggagaacgtcgacttggccgctcgcgagctggtgtatggccccaacaaggtctgtggtttgacctcgcccagcgcggcgcagaccgctcgggctgccggtgcggtgtacggtggcctcatcttcgaggaggcgtcgccgaggaacgtcagccgggaaacgctgcagaaaatcatcgccgccgagcccaatctgcgctatgtcgcggtgagccgccgcacgtcgggatacaaagaccttttggtcgatggcatcttcgccgtgcagattcatgcgccgctccaagacagcgtcgaggccgagaaagcgctcatcgcggccgtgcgcgaggaggtcggtccacaagtccaggtgtggcgcgccatctccatgtcgtcgcccctgggagccgaagtggcggcagccgtcgagggcgacgtcgacaagctgatcctcgacgcgcacgagggcggctccggtgaagttttcgactgggccaccgtccccgcagcggtgaaagcgaaaagcctgctggctggcggcatctcgcccgacaatgcagcccaggccctggccgtgggctgcgctggcctcgacatcaactcgggcgtggagtatcctgccggggcggggacctgggcgggtgccaaagacgcgggggcgctgctcaagatcttcgccaccataagcaccttccattat

SEQ ID NO: 104 - protein, 474 aa, Artificial sequence
  Synthetic Construct
MTSNNLPTVLESIVEGRRGHLEEIRARIAHVDVDALPKSTRSLFDSLNQGRGGARFIMECKSASPSLGMIREHYQPGEIARVYSRYASGISVLCEPDRFGGDYDHLATVAATSHLPVLCKDFIIDPVQVHAARYFGADAILLMLSVLDDEEYAALAAEAARFDLDILTEVIDEEEVARAIKLGAKIFGVNHRNLHDLSIDLDRSRRLSKLIPADAVLVSESGVRDTETVRQLGGHSNAFLVGSQLTSQENVDLAARELVYGPNKVCGLTSPSAAQTARAAGAVYGGLIFEEASPRNVSRETLQKIIAAEPNLRYVAVSRRTSGYKDLLVDGIFAVQIHAPLQDSVEAEKALIAAVREEVGPQVQVWRAISMSSPLGAEVAAAVEGDVDKLILDAHEGGSGEVFDWATVPAAVKAKSLLAGGISPDNAAQALAVGCAGLDINSGVEYPAGAGTWAGAKDAGALLKIFATISTFHY

SEQ ID NO: 105 - DNA, 1359 bp, Artificial sequence
  Synthetic construct
  CDS (1)..(1359): C. glutamicum  ribosylanthranilate isomerase (codon optimized)
atgatgcaaaccgttctcgctaagatagtcgccgacaaagccatttgggttgaaactcgcaaacaacagcaacccctcgcctcgtttcagaatgaaatccagccgagcacccgccacttctacgatgcgctgcagggcgcgaggaccgcgttcatactggagtgcaagaaagcctccccgtcgaagggtgtcatccgggacgacttcgatccagcgcggatcgccgccatttacaagcattatgcgagtgccatctcggtgctcaccgacgagaagtatttccagggcagcttcgacttcctgccgatcgtcagccagatcgccccgcagccgatcttgtgcaaggacttcatcatcgacccctaccagatctacctcgcgcggtattaccaggccgacgcgtgcctcctcatgctctccgtcctggacgacgagcaatataggcagctcgccacggtcgctcactcccttgagatgggcgtgctgaccgaggtgagcaacgaagaggaactggagcgggcgatcgctctcggcgccaaagtcgtgggtatcaataaccgggaccttcgcgacctgtcgatcgacctgaatcgcacccgcgagctggcaccgaagctcggccataacgttacggtcatttcggagtccggcatcaatacctacgcccaggtccgcgagctctcgcacttcacgaacggttttctgatcgggtcggccctcatggcccatgacgacctcaatgccgcggtcaggcgcgtcctcctgggcgagaacaaagtctgcggtctgacccgcgagcaagatgcgaaggctgcgtatgacgcgggagcgatttatggcggccttatcttcgtggcgacgagtccgcgctgtgtcaacgtcgaacaggcgcaagaggtcatggctgcagcgcccctgcaatacgtgggcgtgttccggaaccatgatatcgcagacgtcgtggacaaggccaaggtcctctccctcgcagcggtgcagctgcacggcaacgaggaccagctgtacatcgataccctgcgcgaggccctgcctgcccatgtggcgatctggaaggccttgagcgtgggggagactctgccggcccgggacttccagcatatcgacaaatatgtgttcgacaatggccagggcggctccggccagcgcttcgattggtcgctgctgaacggccagagcctgggtaacgtgttgctcgccggtggcctgggggcagacaactgcgtcgaggcagcgcaaacgggctgcgctggactcgatttcaattccgccgtggagtcccagcccggcatcaaggatgcgcgcctgctggcctcggtgttccagaccctgcgcgcctac

SEQ ID NO: 106 - protein, 453 aa, Artificial sequence
  Synthetic Construct
MMQTVLAKIVADKAIWVETRKQQQPLASFQNEIQPSTRHFYDALQGARTAFILECKKASPSKGVIRDDFDPARIAAIYKHYASAISVLTDEKYFQGSFDFLPIVSQIAPQPILCKDFIIDPYQIYLARYYQADACLLMLSVLDDEQYRQLATVAHSLEMGVLTEVSNEEELERAIALGAKVVGINNRDLRDLSIDLNRTRELAPKLGHNVTVISESGINTYAQVRELSHFTNGFLIGSALMAHDDLNAAVRRVLLGENKVCGLTREQDAKAAYDAGAIYGGLIFVATSPRCVNVEQAQEVMAAAPLQYVGVFRNHDIADVVDKAKVLSLAAVQLHGNEDQLYIDTLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 107 - DNA, 1422 bp, Artificial sequence
  Synthetic construct
  CDS (1)..(1422): E. coli K-12 fused indole-3-glycerolphosphate synthetase/N-(5-phosphoribosyl)anthranilate isomerase (codon optimized)
atgacctccaataacctccccaccgtgctcgaatcgatcgttgaaggacgccgcggccatctcgaagagattagggcgcgcatcgcgcatgtcgacgtggacgccctgcccaagtcgacccgctccctcttcgatagcctgaaccaggggcgcggtggggctcgcttcatcatggagtgcaagagcgcgtcgccttccttgggcatgatccgggagcattatcaaccgggagagatcgcacgcgtgtactcccggtacgccagcggcatcagtgtcctgtgtgagcccgaccggtttggcggcgactacgaccacctggccacggtcgccgcgacgtcgcaccttccggtgctctgcaaggacttcatcattgacccagtccaggtgcacgcagcccgctatttcggcgcagatgcgatcctgctcatgctgagcgtgctcgacgacgaggagtatgcggcgctcgcggcagaggccgcacggttcgacctggacatcctgaccgaagtgatcgacgaggaggaggtcgccagggccatcaagctcggcgccaagattttcggcgtcaaccatcgcaatctccatgacctgtcgatcgatctcgaccggtccaggcgcctgagcaaactgatcccggcggacgccgtcctcgtgtcggagtccggggtgcgggacaccgaaacggtccgccagctcggtgggcatagcaacgcgttcctggtgggcagccagctgacctcgcaggagaacgtcgacctcgcggcacgcgagctcgtgtacggcccgaataaagtgtgcggactgaccagcccctccgccgctcagacggctcgcgctgccggtgcggtctatggcggcctgatcttcgaggaggccagtccgcgcaacgtcagccgcgagactcttcagaagatcatagccgcggagccgaatcttcgctatgttgcggtgagccggcgcaccagcggttacaaagacctcctggtggacggcatcttcgcggtgcagatccacgctccgctgcaggattcggtcgaggccgagaaggccctcatcgctgccgtccgcgaagaggtcggtccgcaagtccaagtgtggcgggcgatctccatgtcctcgccgctgggtgccgaagtggcggcggctgtcgagggcgatgtcgacaagctgatcttggacgcgcatgagggcggctcgggcgaggtctttgattgggcgaccgtcccggcagcggttaaggccaaaagtctgctggccggcggcatctcgcccgataacgctgcgcaagcgctcgcggtcggctgcgccggtcttgacataaactcgggcgtggagtatccggcgggcgccggcacgtgggcgggtgccaaagatgccggcgccttgctgaagatcttcgccaccatctccaccttccattac

SEQ ID NO: 108 - protein, 474 aa, Artificial sequence; identical to SEQ ID NO: 104
  Synthetic Construct

SEQ ID NO: 109 - DNA, 1359 bp, Artificial sequence
  Synthetic construct
  CDS (1)..(1359): E. coli trpF (Acc. No. AAC74344.3) (codon optimized)
atgatgcaaactgttctcgccaagatcgtcgcagacaaagctatttgggttgaagccaggaaacaacaacaacccctggcgtccttccagaacgaggtccagccctcgacccggcacttctacgacgccctccagggtgcgcgcacggcgttcatcctggagtgcaagaaggcctcgccgagcaagggcgtgatccgcgacgactttgatcccgcacggatagcggccatctataagcattacgcgtcggcgatctcggtgctcaccgacgagaagtacttccagggcagcttcaatttccttccgatcgtgtcccagatcgcgccacagccgatcctgtgcaaggacttcatcatcgacccgtaccagatctatctggcgcgctattatcaggccgatgcctgccttctcatgctctcggtgctggacgatgaccagtaccggcagctcgctgcggtcgcgcactccctggaaatgggtgtgctgaccgaggtgtccaatgaagaggagcaagagcgcgcgattgcgctgggggccaaggtcgtgggcatcaacaaccgcgacctgagggatctctcgatcgacctcaatcggacccgcgagctcgccccgaagctcggccataacgtgaccgtcatctcggagagcggcattaacacctatgcgcaagtccgggaactcagccacttcgcgaatggcttcctcattggcagtgccctgatggcgcatgacgacttgcatgctgcggtgcggcgcgtcctgttgggcgagaacaaagtctgcggcctcacccgcggccaagacgcgaaagccgcctatgacgccggtgcgatctatggcggcctgatcttcgtcgccacctccccgcgctgcgtgaatgtcgagcaggcacaagaggtcatggctgcagccccgctgcagtacgtcggcgtctttcgcaatcatgacatcgccgacgtcgttgacaaggccaaggtcctgtcgctggccgccgtccagctgcatggcaacgaggaacagctctacatagatacgctgcgcgaggcacttcccgcgcatgtggcgatctggaaggccctcagcgtgggcgaaacgctgcctgcgcgcgagttccaacacgtggacaagtatgtgctcgataacggccagggcggctcgggccagcgcttcgactggagcctgctgaacggtcagtccctcgggaatgtgctgcttgcgggtggcctcggagccgataactgtgtcgaggccgcacagacgggctgcgccggactcgacttcaacagcgcggtggagtcgcagccggggatcaaagacgctcgcctgctggcgtccgtgttccagaccttgcgggcctac

SEQ ID NO: 110 - protein, 453 aa, Artificial sequence
  Synthetic Construct
MMQTVLAKIVADKAIWVEARKQQQPLASFQNEVQPSTRHFYDALQGARTAFILECKKASPSKGVIRDDFDPARIAAIYKHYASAISVLTDEKYFQGSFNFLPIVSQIAPQPILCKDFIIDPYQIYLARYYQADACLLMLSVLDDDQYRQLAAVAHSLEMGVLTEVSNEEEQERAIALGAKVVGINNRDLRDLSIDLNRTRELAPKLGHNVTVISESGINTYAQVRELSHFANGFLIGSALMAHDDLHAAVRRVLLGENKVCGLTRGQDAKAAYDAGAIYGGLIFVATSPRCVNVEQAQEVMAAAPLQYVGVFRNHDIADVVDKAKVLSLAAVQLHGNEEQLYIDTLREALPAHVAIWKALSVGETLPAREFQHVDKYVLDNGQGGSGQRFDWSLLNGQSLGNVLLAGGLGADNCVEAAQTGCAGLDFNSAVESQPGIKDARLLASVFQTLRAY

SEQ ID NO: 111 - DNA, 1422 bp, Artificial sequence
  Synthetic construct
  CDS (1)..(1422): Corynebacterium glutamicum (ATCC 13032) bifunctional indole-3-glycerol phosphate synthase/phosphoribosylanthranilate isomerase (trpF) (codon optimized)
atgacctccaacaacctccccaccgttcttgagtccatcgttgaaggccgccgcggacacctcgaagaaatccgcgcccggattgcgcacgtcgatgtggacgcgctgcccaagagcacgcgcagcctcttcgattcgctgaatcagggccggggcggcgcgcggtttatcatggagtgcaagtccgcgtcgccgtcgctgggtatgattcgggagcattatcagccgggtgagatcgcacgcgtgtatagccgctacgcctccgggatctcggtgctctgcgagccagatcggtttggtggcgactacgaccatctcgccaccgtggcggccacgtcgcatctcccggtgctgtgtaaggatttcatcatcgacccggtccaagtgcacgcggctcgctatttcggtgcggacgcgatcctcctcatgctgagcgtcctggacgatgaagagtacgccgcgctggccgcagaggccgctcgcttcgacctcgacattctcaccgaggtcatagacgaggaagaggtcgccagggcgatcaagctcggcgcgaagattttcggcgtcaatcatcggaatctccacgacctgagcatcgacctcgatcggtcgcgccggctgtccaagctgatccccgcagatgccgtgctggtcagcgagtcgggcgtgagggacaccgaaacggtgcgccagctcggtggccattccaacgccttcctcgtgggctcccagctgacctcgcaggaaaacgtcgacttggcagcgcgcgagctcgtctatggccccaacaaagtctgcggccttacgagtccctcggcggcgcagactgcccgcgcggccggtgccgtgtacggcgggttgatcttcgaagaggcctcgcctcgcaacgtgagtcgcgaaacgcttcaaaagatcatcgcggctgagccgaatctgcggtacgtggctgtgagccgcaggaccagcggctacaaggaccttctggtcgacggcatattcgccgtgcaaatccacgcgcccctgcaggattcggtcgaggcagaaaaggccctcatcgctgccgtgcgggaagaggttggcccgcaagtccaggtctggcgcgctatttccatgtcgagtccgctgggcgctgaggtcgctgccgcggtcgagggcgacgtggacaagttgatcctggacgcacatgagggcggctccggcgaggtgttcgactgggccaccgtcccggctgccgtcaaagcgaaatccctgctcgcgggcggcatcagccccgataacgccgcacaggcactggccgtcggctgcgcgggactggacatcaatagcggtgtcgagtatccggcgggggcgggtacctgggcgggggcgaaagacgcgggagccctcctgaagatcttcgccaccatctcgaccttccattac

SEQ ID NO: 112 - protein, 474 aa, Artificial sequence; identical to SEQ ID NO: 104
  Synthetic Construct

SEQ ID NO: 113 - DNA, 804 bp, Artificial sequence
  Synthetic construct
  CDS (1)..(804): E.coli  tryptophan synthase alpha subunit (trpA) (codon optimized)
atggaacgctatgaatcgttgttcgcccaactgaaggaaaggaaagaaggcgcatttgtcccctttgtgactctgggcgatccgggcatcgagcagtccctcaagatcatcgacaccctgatcgaggccggagcggacgcccttgagctggggatccctttcagcgacccgctggcggacggcccgaccatccagaatgccaccctccgggcgttcgcggctggcgtgacgccggcacagtgcttcgagatgttggcgctgatccgccaaaagcatccgacgatccccattggcctcctcatgtacgcgaacctcgtgttcaacaaaggcatagacgagttctatgcgcagtgcgagaaggtcggcgtcgactccgtgctggtcgccgatgtgccggtcgaagagagtgcgcccttccgccaggctgcgcttcgccacaacgttgccccgatcttcatctgcccaccgaatgccgacgacgatctgctgcgccagattgcgagctacggtcggggttacacctacctcctctcgcgcgcaggcgtcacgggcgctgagaatcgggctgccctcccgctgaaccatctcgtcgcgaagctgaaagagtataacgccgctccgccgctgcagggcttcggcatctcggcgcccgaccaagtcaaggccgcgatcgacgccggggccgcgggtgccatctcgggctccgccatcgtgaagatcatagagcagcacatcaacgaacccgagaaaatgctcgcggcgctgaaagtgttcgtccagcccatgaaagccgcaacccgcagc

SEQ ID NO: 114 - protein, 268 aa, Artificial sequence; identical to SEQ ID NO: 54
  Synthetic Construct

SEQ ID NO: 115 - DNA, 840 bp, Artificial sequence
  Synthetic construct
  CDS (1)..(840): Corynebacterium glutamicum (ATCC 13032)  tryptophan synthase subunit alpha (trpA) (codon optimized)
atgtcccgctatgatgacctgttcgcacgccttgatactgccggagaaggtgcctttgtcccattcataatgttgagcgatccgagcccggaagaggctttccagatcattagcacggccatcgaggccggagccgacgcgctcgaactgggtgtgccgttctcggaccccgtggccgacggccccaccgtcgcggagagtcatctgagggccctcgacggcggcgccaccgtcgactcggcgctggaacagatcaagcgcgttcgggccgcgtaccctgaggtcccgatcggcatgctgatctatggtaacgtgccgttcacccggggcctcgatcgcttctaccaggagttcgccgaggctggcgcggactcgattctcctccccgacgtgccggtgcgcgagggcgctccgttctccgcagcggctgcggcagcgggcatcgacccgatctatatagcgcccgcgaatgcgtcggagaaaacgcttgagggtgtctcggcggcatcgaagggctacatctacgccatctcgcgggacggcgtcacgggcaccgagcgcgagtcgagcaccgacgggctgtccgccgtcgtcgacaatatcaagaaattcgacggggcgcccatcctgctcggcttcggcatctcgtccccgcaacacgtggcggacgccatcgccgccggcgcgagcggtgcgatcaccgggtccgcgatcaccaagatcattgcctcccattgcgagggcgagcacccgaacccctccacgatccgcgatatggacggcctcaagaaagacctgaccgagttcatcagcgcgatgaaagccgccaccaaaaaggtg

SEQ ID NO: 116 - protein, 280 aa, Artificial sequence; identical to SEQ ID NO: 56
  Synthetic Construct

SEQ ID NO: 117 - DNA, 1191 bp, Artificial sequence
  Synthetic construct
  CDS (1)..(1191): E. coli trypophan synthase beta subunit (trpB) (Acc. No. AAA57300.1) (codon optimized)
atgaccaccctgcttaacccatacttcggagaattcggcggaatgtacgtccctcaaatcctcatgccggcactccgccagctggaagaagcgttcgtgagcgcccaaaaggaccccgagttccaggcgcaattcaatgacttgctcaagaactatgccggccgcccgaccgcgctgaccaagtgtcagaatatcaccgcaggcaccaacaccaccctctatcttaagcgcgaggatctcctccacggcggagcgcacaagacgaaccaagtcctgggccaggccctcctcgccaagcggatgggcaagaccgagataatcgcggaaacgggtgcgggccagcatggtgtggcttccgcgctggcctcggcgctcctcgggctgaagtgccgcatctacatgggcgcgaaagacgtggagcggcagtcgcccaacgtgttccggatgcgcctgatgggtgccgaggttatcccggtccattccggcagcgccaccttgaaagacgcctgcaatgaagcgctccgggactggtccggctcctatgagactgcgcattacatgctcggcacggctgctggcccccacccgtatccgacgatcgtccgcgagttccagcgcatgatcggcgaggaaaccaaggcacagatactggagcgcgagggccgcttgccggacgccgtcatcgcctgcgtcggtggcggctccaacgctatcggcatgttcgcggattttatcaatgaaacgaacgtcggcctgattggggtggagccgggtggccatggcatcgagactggcgagcatggcgcaccgctgaaacatggccgcgtggggatctacttcggcatgaaagccccgatgatgcagaccgaggacgggcagattgaggagagctattcgatttccgccgggctggattttccctcggtgggtccgcagcacgcgtacctcaatagcaccggtagggccgactacgtcagcatcaccgacgacgaggccctggaagcattcaagacgctctgcctgcatgagggcatcatcccggccctggagtcgagtcacgcgctggcccatgcgctgaagatgatgcgggagaatcccgacaaagagcaactgctggtcgtcaacctgtcgggcaggggtgacaaagatatcttcaccgtgcatgatatccttaaggcccgcggcgagatc

SEQ ID NO: 118 - protein, 397 aa, Artificial sequence [sequence omitted]

SEQ ID NO: 119 - DNA, 1251 bp, Artificial sequence
  Synthetic construct
  CDS (1)..(1251): Corynebacterium glutamicum (ATCC 13032) tryptophan synthase subunit beta (codon optimized)
atgacggaaaaagaaaacttgggtggatcgacgttgcttcccgcatatttcggagaatttggtggccagtttgtggccgagtccctgctcccagcgctggaccagcttgagaaggccttcgtggacgccaccaacagccccgagttccgcgaggaactcggcggctacctccgcgactatctgggcaggccgaccccgctcactgagtgctccaatctgccgctggccggtgagggcaagggcttcgcgcgcatcttcctcaagcgcgaggacctcgtgcacggcggcgcccataagaccaaccaagtgattggccaagtcctgcttgcgaagcggatgggcaagacgcgcatcatcgcggaaactggtgccgggcagcacggcacggcgaccgcgctcgcttgcgcgctgatgggcctggagtgcgtggtgtatatgggtgccaaagacgtcgcacggcagcagcccaacgtctaccgcatgcagctccatggcgccaaggtcatcccggtggagagcgggagcggcaccctgaaagatgccgtcaatgaggctctgcgggactggacggcgaccttccatgagtcccattatctgctcggcaccgccgcgggcccgcatccgttccctacgatcgtccgcgagttccacaaggtcataagtgaagaggccaaggcccagatgctggagcggacgggcaagctgcccgatgtcgttgtggcgtgcgttggtggcgggtcgaatgcgatcggcatgttcgcggatttcatcgatgatgagggcgtcgagctcgtgggagcggagccggctggtgagggcctcgactcgggcaagcatggggcaaccatcaccaacggccagattggcatcctgcacggcacccgctcctatctgatgcgcaactccgacggccaggtcgaggagtcgtactcgatcagcgctgggctcgactatccgggcgtcggaccgcagcatgcgcacctccatgccaccggtcgggcgacctacgtcggcatcaccgacgccgaggccctgcaagcgttccagtacctggcgcgctacgagggcatcattccggccctggagtcctcgcatgccttcgcgtacgcgctcaagcgcgccaaaacggctgaggaagagggccaaaacttgaccatcctcgtcagtctgagcggtaggggcgacaaagacgtcgaccatgtgcgccggaccctggaagagaatcccgagcttatcctcaaagacaaccgc

SEQ ID NO: 120 - protein, 417 aa, Artificial sequence
  Synthetic Construct
MTEKENLGGSTLLPAYFGEFGGQFVAESLLPALDQLEKAFVDATNSPEFREELGGYLRDYLGRPTPLTECSNLPLAGEGKGFARIFLKREDLVHGGAHKTNQVIGQVLLAKRMGKTRIIAETGAGQHGTATALACALMGLECVVYMGAKDVARQQPNVYRMQLHGAKVIPVESGSGTLKDAVNEALRDWTATFHESHYLLGTAAGPHPFPTIVREFHKVISEEAKAQMLERTGKLPDVVVACVGGGSNAIGMFADFIDDEGVELVGAEPAGEGLDSGKHGATITNGQIGILHGTRSYLMRNSDGQVEESYSISAGLDYPGVGPQHAHLHATGRATYVGITDAEALQAFQYLARYEGIIPALESSHAFAYALKRAKTAEEEGQNLTILVSLSGRGDKDVDHVRRTLEENPELILKDNR

SEQ ID NO: 121 - DNA, 876 bp, Artificial sequence
  Synthetic construct
  CDS (1)..(876): Dihydrodipicolinate synthase (dapA)  MCA0671
atgattcaaggcagtatcgttgccctggcaacgcccatggaacccgatgggaggctggatgttcccggcctcaggcgactggtcgagttccacatcgaacaggggacggatgccatcgtggcggtggggacgaccggcgaatcggcgacgctggacgaggaagaacacacggaagtcatccgtctggtggtggagcaggccgccggcagaatcccggtcatcgccggtaccggtgcgaacgcgaccaccgaagccatccgtttgaccgccagggccaaggccgtcggcgccgacgcgtgtctcctcgtcacgccgtattacaacaagccgacccaggagggcctctaccgccattacctggcggtcgccgaggcagtggacattccgcagatcctttacaacgtgcccggccgtaccggctgcgacatgctgccggccaccgtcgggcggctggcgcaggttcccggcatcgtcggaatcaaggaagcgaccggcaagctcgagcggctggccgagatccgggcgctgtgccccgaggggttcgccctgtattccggcgacgacgcaacggcgtgcgaattctgcctgtcgggcggcaacggcgtgatctcggtcacggccaacgtggcgccgcgtctcatgcaggagatgtgccgagcggccatcgccggtgaccgggcgacggccgaggcgatcaaccgccggctcgaggccctgcaccatgatctgttcatcgagtccaatcccatacccgtgaaatgggcactgcacgaaatgggactgatccaggagggaatccgtctgccgctgacctggctggccgcgtcctgccgggaggcggtgcgccaggccatgcgtcaggccggcgtgctctga

SEQ ID NO: 122 - protein, 291 aa, Artificial sequence
  Synthetic Construct
MIQGSIVALATPMEPDGRLDVPGLRRLVEFHIEQGTDAIVAVGTTGESATLDEEEHTEVIRLVVEQAAGRIPVIAGTGANATTEAIRLTARAKAVGADACLLVTPYYNKPTQEGLYRHYLAVAEAVDIPQILYNVPGRTGCDMLPATVGRLAQVPGIVGIKEATGKLERLAEIRALCPEGFALYSGDDATACEFCLSGGNGVISVTANVAPRLMQEMCRAAIAGDRATAEAINRRLEALHHDLFIESNPIPVKWALHEMGLIQEGIRLPLTWLAASCREAVRQAMRQAGVL

SEQ ID NO: 123 - DNA, 1248 bp, Artificial sequence
  Synthetic construct
  CDS (1)..(1248): Diaminopimelate decarboxylase; (lysA) MCA0858
atggatcatttcaattatcgtgacggcatcctccacgtcgaggacgtcccgctgtccgccatcgccgaacagcatggaacgccctgctacgtttactcccgcgccacgctggagcggcactggcatgccttcgacgctgcgctgggcgactgcccgcatctggtctgctatgccgtcaaggccaactccaacatcgccatcctgaatctgctggcgcggctggggtcgggcttcgacatcgtctcggtcggcgagctggaacgggtattggcggcaggtggcgacccttccagagtggtgttctccggcgtcggcaagcgcgaggacgagttggcgcgtgctctggataccggcatccgctgcttcaatgtcgaggtggccgaagagctcgaccggctcgaccggctggccggcgagcgcggcgtcaaggcgccggtgtcgctgcgggtgaatccggacgtcgacgccggcacccacccttacatctcgaccggcctgagcgagaacaagttcggcatcgaagtggaagaggcgctcgtgcagtaccgccgtgcggcgcggatgcccaacctggaagtcgtcggcatcgattgccacatcggttcgcagctgaccagttccatgccgttcatcgacgcgctggaccgggtgctggcgttggtcgctcggctgcgcggcgaaggcatcgcgatacgccacctggacctgggcggcggcctgggtatccgttaccgcgacgaggatccgccgcatccgacggaatacgccgagcagcttttccgccggctcggccgccacgatttcgaaatcctgatcgagccgggccgtgcggtcgccggtaacgccggtatcttgctgacccggctggaatatctcaaagccaatcagaccaagcatttcgcgatcgtcgacgcggcgatgaacgatctgctgcgcccggcgctgtacggtgcctggcaggagatcgtcccggtcgcaccacgtaacgatgtggagtcgcacagctacgatgtcgtgggaccggtctgcgagaccggcgatttcctgggcaagtcgcgcgagctgagactggtcccgggcgacctgctggcggtgcgctctgccggagcctacggtttcagcatgagttcgaattacaactcccggccacggccggccgaaatcctggtggatggcagcgccgtgtacctgatccgggagcgggagaacgtggctcgacttttcgccggtgagcggctgctgccgtag

SEQ ID NO: 124 - protein, 415 aa, Artificial sequence
  Synthetic Construct
MDHFNYRDGILHVEDVPLSAIAEQHGTPCYVYSRATLERHWHAFDAALGDCPHLVCYAVKANSNIAILNLLARLGSGFDIVSVGELERVLAAGGDPSRVVFSGVGKREDELARALDTGIRCFNVEVAEELDRLDRLAGERGVKAPVSLRVNPDVDAGTHPYISTGLSENKFGIEVEEALVQYRRAARMPNLEVVGIDCHIGSQLTSSMPFIDALDRVLALVARLRGEGIAIRHLDLGGGLGIRYRDEDPPHPTEYAEQLFRRLGRHDFEILIEPGRAVAGNAGILLTRLEYLKANQTKHFAIVDAAMNDLLRPALYGAWQEIVPVAPRNDVESHSYDVVGPVCETGDFLGKSRELRLVPGDLLAVRSAGAYGFSMSSNYNSRPRPAEILVDGSAVYLIRERENVARLFAGERLLP

SEQ ID NO: 125 - DNA, 828 bp, Artificial sequence
  Synthetic construct
  CDS (1)..(828): Diaminopimelate epimerase (dapF)  MCA0859
atgctgcgtttcaccaagatgcaggggctgggcaacgacttcgtcgtgatcgatgccattcatcagacagtgaacctggatgaggcggcattgcgccggctggccgaccggcattacggcataggctgcgaccagatcctgctggtggagccgccggcttccgacgaggtggatttccgctatcggattttcaacgctgacggcggagaggtctcgcagtgtggcaatggcgcgcgctgctttgcccgcttcgtgcgcgagaaggggctcatcgaccgcgacgagatccgggtggaaaccgcggccggccgcatggtcctgtggctggaggcgggcggtgaagtcagggtcgaaatgggagtgcctcgccatgcgcctgccgaggtcccgctgctggcggatcgggagcggtcggtctacacggtgaacgtcgagggcgtggactggcagttcggcgcggtctccgtgggcaatccccatgcggtgatcacggtagccgatgtcgacgaggcgccggtggcgcgcgtcggcacggtgctggaacggcacgagctattccccgaacgcgccaacatcggtttcatgcaggtcctggatctgcatcatgcgcgcctcagggtctatgagcgtgggacgggggaaaccctggcctgtggcagtggcgcctgtgccgccgcagtggtcggcatattgcaggggacgctggaaagtcccgtgcgcatcgacctgccgggcggcacgctgcggatcggctggcagggaagggggacgccggtttacctgagtggcccggcagttaccgtgttcgaggggaggatggcaacatga

SEQ ID NO: 126 - protein, 275 aa, Artificial sequence
  Synthetic Construct
MLRFTKMQGLGNDFVVIDAIHQTVNLDEAALRRLADRHYGIGCDQILLVEPPASDEVDFRYRIFNADGGEVSQCGNGARCFARFVREKGLIDRDEIRVETAAGRMVLWLEAGGEVRVEMGVPRHAPAEVPLLADRERSVYTVNVEGVDWQFGAVSVGNPHAVITVADVDEAPVARVGTVLERHELFPERANIGFMQVLDLHHARLRVYERGTGETLACGSGACAAAVVGILQGTLESPVRIDLPGGTLRIGWQGRGTPVYLSGPAVTVFEGRMAT

SEQ ID NO: 127 - DNA, 1134 bp, Artificial sequence
  Synthetic construct
  CDS (1)..(1134): Succinyldiaminopimelate desuccinylase (dapE) MCA1553
atgagcgacaccctcgatctcgccgtcgagctgatccggcgcgaatccgtgacccccgaagatgcgggctgcatggacctggtgatcgagcggctggcgccccatggcttccaggccgagtggctgaatttcggtgacaccaagaacctctggctccgacgcggcgaagcggcgccgctcttcgtgttcctgggccataccgacgtggtgccgccgggtcccctggaagactggtcctccccccccttcgcgcccgaaatccgcgaaggccgactgtacggacgtggcgcggccgatatgaagggcagtatcgcagccatgaccacggccttgcagcggttcgtggtccaccaccccgggcacccgggctccctcgccgtcctgctgaccagtgacgaagagggctcggcctacgacggcgtggtcaaggtggtggatgtcctgaagtcgcgagacacggtgatcgactggtgtctggtcggcgagccgtcgagcttcgcccggctgggcgatgtgatccgggtgggccgccgaggctccttgggcggcgtgctgcggatcctgggcgtgcagggccacgtcgcttatcccgacaaggccgacaaccccatccaccgcttcgctcccgcgcttcacgaactcactaccgaaatctgggacggaggcaacgaattcttccctccgaccagttttcaggtctccaacatccgggcgggaaccggcgccgacaacgtcatccccggcaaactcgaggttctgttcaacttccgtttttcgaccgaactgaccgtggaggccatccagcgccgtgtggaaaccatcctcgaccgccacggcctccactacgaattgagctggcgactctccggtctgccgtttttgacccgggaaacggagctggtgagcgcgacccgtgccgccatcgccgcagtcaccggcctccagccgcgtgccgataccggcggcggcacttccgatggccgcttcatcgccccgaccggtgcccaggtcgtggagctgggaccgctcaacggcagcatccacaagatcgatgagcacgttgcggtcgaagacctggaagccctgtccgcgatctacgaacgcatcctcggcaatctgctggcggtcctctga

SEQ ID NO: 128 - protein, 377 aa, Artificial sequence
  Synthetic Construct
MSDTLDLAVELIRRESVTPEDAGCMDLVIERLAPHGFQAEWLNFGDTKNLWLRRGEAAPLFVFLGHTDVVPPGPLEDWSSPPFAPEIREGRLYGRGAADMKGSIAAMTTALQRFVVHHPGHPGSLAVLLTSDEEGSAYDGVVKVVDVLKSRDTVIDWCLVGEPSSFARLGDVIRVGRRGSLGGVLRILGVQGHVAYPDKADNPIHRFAPALHELTTEIWDGGNEFFPPTSFQVSNIRAGTGADNVIPGKLEVLFNFRFSTELTVEAIQRRVETILDRHGLHYELSWRLSGLPFLTRETELVSATRAAIAAVTGLQPRADTGGGTSDGRFIAPTGAQVVELGPLNGSIHKIDEHVAVEDLEALSAIYERILGNLLAVL

SEQ ID NO: 129 - DNA, 1023 bp, Artificial sequence
  Synthetic construct
  CDS (1)..(1023): Aspartate-semialdehyde dehydrogenase (asd) MCA2062
atgagcaagacctacaacgtcgccgtgctgggtgccaccggggccgtcggcgaaacgatgctgtccatcctggaccagcgccagttcccggtgggtgaggtatacgcgctggccagcagccgttccgccggtcagcgcgtggagttccgggacagccggctcaaagtgttggacgtcgaggaattcgactggtcccaggtccagatcgggctgttttcgcccggcgcctcggtttctgacgtctacgcgcctcaggcggcagcggccggttgtgtggtgatcgacaatacctcgcgattccgctacgaggacgacatcccgctggtggtgccggaggtcaatccggagaagatcgccgattaccggaaccgcggcatcatcgccaaccccaactgttccaccatccagatgctggtggcgctgaagccgatctacgacgccgtcggcatcgaacgcatcaacgtctgcacctaccaggcggtgtccggcaccggcaaaaaggccatcgaggaactcgccggtcaggccgcgcaattgctcaacggccggccgtgccagtcttcggtgtatcccaaacagatcgctttcaacgtgttgccgcagatcgacgtctttctggacaacggttacaccaaggaagagatgaagatggtctgggagacccggaagatcatgggtgatgattccattcgggtgaatccgaccacggtgcgggtgccggtgttctacggtcattcggaggccgtgcacatcgagacccgtgacaagatcacggcggatcaggcgcgggcgttgctgcggaaggcgccgggcgtcgtggtgctcgacgagcaccagccgggaggctacccgaccgccgtcacggaggccgctggcaaggacccggtgttcgtcggccgtatccgcgaggacatttctcatccgcgcggcctgaatctgtgggtggtcgcggataacatccgcaagggcgcggcgctcaacagcgtgcagattgcggagatattgatagacaagtatatttga

SEQ ID NO: 130 - protein, 340 aa, Artificial sequence
  Synthetic Construct
MSKTYNVAVLGATGAVGETMLSILDQRQFPVGEVYALASSRSAGQRVEFRDSRLKVLDVEEFDWSQVQIGLFSPGASVSDVYAPQAAAAGCVVIDNTSRFRYEDDIPLVVPEVNPEKIADYRNRGIIANPNCSTIQMLVALKPIYDAVGIERINVCTYQAVSGTGKKAIEELAGQAAQLLNGRPCQSSVYPKQIAFNVLPQIDVFLDNGYTKEEMKMVWETRKIMGDDSIRVNPTTVRVPVFYGHSEAVHIETRDKITADQARALLRKAPGVVVLDEHQPGGYPTAVTEAAGKDPVFVGRIREDISHPRGLNLWVVADNIRKGAALNSVQIAEILIDKYI

SEQ ID NO: 131 - DNA, 810 bp, Artificial sequence
  Synthetic construct
  CDS (1)..(810): Dihydrodipicolinate reductase (dapB) MCA1854
atggtgatcagaacaggaatagcgggtgtcgccggccggatgggcggcaatctcgtgcgcgcatgcttagccgatccggcagtggagctaacggcggcgatcgcgcgtcccgggagtccggtggtggggcgcgacgcgggcgagctggccggtttgtcggcgatcggtttgcccgtggtcggcaacctgagcgaagtttcggacaaagtcgatgtactgatcgacttcaccctgccggaagtcacgctggcccatctcgaatcctgccgttcggccggaatccggctggtgatcggcacgaccggtttcagcgcggagcagcgccagctcatagccgccgccgcggagggcatgggtatcgtgttcgcgcccaacatgagcgtgggtgtgaatctggccctcaagctgctggatatcgccgcccgggtggtgggcgagcatgccgacatcgagatcgtcgaggcgcatcaccgccataagatcgacgcgccctccggaaccgcgctgcgcatgggcgaagtggtggcgaaagccttggggcggaacttgcaggactgcgcgatctacggccgcgaaggcatcaccgggatacgcgatgccaagaccatcggtttctccaccatccgcgccggcgacatcgtcggcgagcacaccgtcatgttcgccgacgaaggcgagcgcatcgagatcacccataaggccagcagccgcatgaccttcgccaagggagcggtcagggcggccgtctggctgatgtcccaaggcgaaggactgttcgacatgcaggacgtgctgggtttgaagggatga

SEQ ID NO: 132 - protein, 269 aa, Artificial sequence
  Synthetic Construct
MVIRTGIAGVAGRMGGNLVRACLADPAVELTAAIARPGSPVVGRDAGELAGLSAIGLPVVGNLSEVSDKVDVLIDFTLPEVTLAHLESCRSAGIRLVIGTTGFSAEQRQLIAAAAEGMGIVFAPNMSVGVNLALKLLDIAARVVGEHADIEIVEAHHRHKIDAPSGTALRMGEVVAKALGRNLQDCAIYGREGITGIRDAKTIGFSTIRAGDIVGEHTVMFADEGERIEITHKASSRMTFAKGAVRAAVWLMSQGEGLFDMQDVLGLKG

SEQ ID NO: 133 - DNA, 1176 bp, Artificial sequence
  Synthetic construct
  CDS (1)..(1176): Acetylornithine aminotransferase (argD)  MCA2079
atgacgagcaacatcatgccgacttatgcccggcaacccgtgacgttcacccacggcgagggagcctggcttttcgacaccgaaggcaaacgctacctcgacgccgtttccggcgtcgccgtctgcagcctgggccacgcccatccggcagttgcgaaggccttgtgcgatcaggcggggcggctggtccactgctccaacctctaccgtatcgggctgcaggaagacctggccaagcagctgtgcgacctgagcgggatggacaatgccttcttttgcaactcaggcgccgaggccaatgaggccgcgctcaagatcgcgcgccgttacggccatcaccgcggtatcgacaccccgaaaatcgtcgtcatggaagggagcttccacggccggacgctggccacgctgagcgccaccggcaaccccaaggtgcaggaaggattcgcccccctggtcggcggcttcgtccgcctcccctacggcgacgcggaggccgtcgccgccgtcgacgaccccgacgtcgtcgccgtcctggtcgaaccggtgcagggcgaaggcggggtccgcattccgcctgacgactacctggcgcggctcaaatcgctgtgcgaacgccgcggctggctgctgatgctcgatgaagtacaaaccggcatgggccgtaccggccggatgttcggccaccaacacaccggggtcaccccggacgtgatggcactggcgaaagcgctcggcaacggcgtgccgatcggtgcctgtctcgcccgcggcgtggccgcggaaatgctcacggccggcaagcacggctccaccttcggcggcaatccgttggcctgcgctgcggccctggcggtgatcgacaccctgacccggcagtccctggcccagcgggcggagatcctcggccagcgactgctggacggcttccggacccgcctgagcggacgtcccggcgtcatcgaaatccgaggcttgggcctgatgatcggtctcgaactcgagcgcccctgtacccgcctcgtcgggatggccctggagcagggcctgctcatcaatgtcaccgcggagcggaccgtgcgcctgctcccgcccctgatactgacggatgcccaggccgacgatctggtggagcgattgtgctccctcgtcgaagcccatctggacgccgccggctga

SEQ ID NO: 134 - protein, 391 aa, Artificial sequence
  Synthetic Construct
MTSNIMPTYARQPVTFTHGEGAWLFDTEGKRYLDAVSGVAVCSLGHAHPAVAKALCDQAGRLVHCSNLYRIGLQEDLAKQLCDLSGMDNAFFCNSGAEANEAALKIARRYGHHRGIDTPKIVVMEGSFHGRTLATLSATGNPKVQEGFAPLVGGFVRLPYGDAEAVAAVDDPDVVAVLVEPVQGEGGVRIPPDDYLARLKSLCERRGWLLMLDEVQTGMGRTGRMFGHQHTGVTPDVMALAKALGNGVPIGACLARGVAAEMLTAGKHGSTFGGNPLACAAALAVIDTLTRQSLAQRAEILGQRLLDGFRTRLSGRPGVIEIRGLGLMIGLELERPCTRLVGMALEQGLLINVTAERTVRLLPPLILTDAQADDLVERLCSLVEAHLDAAG

SEQ ID NO: 135 - DNA, 2463 bp, Artificial sequence
  Synthetic construct
  CDS (1)..(2463): E. coli Aspartate kinase I (thrA)
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 136 - protein, 820 aa, Artificial sequence
  Synthetic Construct
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 137 - DNA, 2433 bp, Artificial sequence
  Synthetic construct
  CDS (1)..(2433): E. coli aspartate kinase II (metL)
atgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgaccttgagcgcctggcggcgctgctcgacagcggtattaacgacgcagtgtatgcggaagtggtgggccacggggaagtatggtcggcacgtctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaa

SEQ ID NO: 138 - protein, 810 aa, Artificial sequence
  Synthetic Construct
MSVIAQAGAKGRQLHKFGGSSLADVKCYLRVAGIMAEYSQPDDMMVVSAAGSTTNQLINWLKLSQTDRLSAHQVQQTLRRYQCDLISGLLPAEEADSLISAFVSDLERLAALLDSGINDAVYAEVVGHGEVWSARLMSAVLNQQGLPAAWLDAREFLRAERAAQPQVDEGLSYPLLQQLLVQHPGKRLVVTGFISRNNAGETVLLGRNGSDYSATQIGALAGVSRVTIWSDVAGVYSADPRKVKDACLLPLLRLDEASELARLAAPVLHARTLQPVSGSEIDLQLRCSYTPDQGSTRIERVLASGTGARIVTSHDDVCLIEFQVPASQDFKLAHKEIDQILKRAQVRPLAVGVHNDRQLLQFCYTSEVADSALKILDEAGLPGELRLRQGLALVAMVGAGVTRNPLHCHRFWQQLKGQPVEFTWQSDDGISLVAVLRTGPTESLIQGLHQSVFRAEKRIGLVLFGKGNIGSRWLELFAREQSTLSARTGFEFVLAGVVDSRRSLLSYDGLDASRALAFFNDEAVEQDEESLFLWMRAHPYDDLVVLDVTASQQLADQYLDFASHGFHVISANKLAGASDSNKYRQIHDAFEKTGRHWLYNATVGAGLPINHTVRDLIDSGDTILSISGIFSGTLSWLFLQFDGSVPFTELVDQAWQQGLTEPDPRDDLSGKDVMRKLVILAREAGYNIEPDQVRVESLVPAHCEGGSIDHFFENGDELNEQMVQRLEAAREMGLVLRYVARFDANGKARVGVEAVREDHPLASLLPCDNVFAIESRWYRDNPLVIRGPGAGRDVTAGAIQSDINRLAQLL

SEQ ID NO: 139 - DNA, 1230 bp, Artificial sequence
  Synthetic construct
  CDS (1)..(1230): Aspartate kinase III (lysC) MCA0390
atggctttattcgtacacaaatacggcggcacctcggtcggctcgccggagcggatcaagaacgtcgcgaagaacgtcatccgggcgcgcagccggggcgacgacatcatcgtcgtggtgtcggccatgagcggcgaaaccaaccgcctggtggcgctggcgcatgaaatgcacgaaaggcccagcacccgtgaaatggatgtgctgctggccaccggcgagcaggtcacgatcgcgctgttgagcatggcgctggaggcggcagggtgcccggcctgttcctataccggcgggcaggtgcggatcctcaccgacgatgcacacaccaaggcgcgcatcctcgacatcgacaccgaccgtatccgcagcgatctcgcggccggacgcgtggtcgtggtggcgggtttccaggggatcaccgaggcgggtgacatcaccaccttggggcggggcggctccgacaccacggcggtcgccctggccgctgcactcaaggcggacgaatgcctgatttataccgacgtggatggcgtctataccacggatccaaggatcgaaccgaaggcgcgccggctggaccgcatcaccttcgaggaaatgctcgaaatggcgagcctggggtccaaggtgctgcagattcgctcggtcgaattcgccggcaagtacaacgtccccctgagagtcttgtccagtttcgcagccggtcccggcacattgattacatatgaggaagcaagtgtggaaaaacctttgatctccggtatcgccttcaatcgcgacgaagcgaaactgaccgtcaagggcgtgccggacaagccgggcgtggcatatcagatcctggggcccgtcgcccatgccaacatcgaagtggacatgatcgtccagaacgtcgcggaggatgcgaccacggatttcacgtttaccgtccaccgcaacgactaccgcaaggcgctcgacatcctgcaggcgacttgcacggccctgggggcgcgcgaagtgacgggagacgacaagatcgtgaaagtttcgctggtgggcgtggggatgcgctcgcatgccgggatcgccgcccggatgttcgaagccctggcgcgggaaggcatcaacatccgcatgatatccacttccgaaatcaagatttccatcgtcgtggacgaaaaatacctcgagctggcggtacgtaccctgcacgaggcgttcaatctcgatcgcgagccggacgcggtttga

SEQ ID NO: 140 - protein, 409 aa, Artificial sequence
  Synthetic Construct
MALFVHKYGGTSVGSPERIKNVAKNVIRARSRGDDIIVVVSAMSGETNRLVALAHEMHERPSTREMDVLLATGEQVTIALLSMALEAAGCPACSYTGGQVRILTDDAHTKARILDIDTDRIRSDLAAGRVVVVAGFQGITEAGDITTLGRGGSDTTAVALAAALKADECLIYTDVDGVYTTDPRIEPKARRLDRITFEEMLEMASLGSKVLQIRSVEFAGKYNVPLRVLSSFAAGPGTLITYEEASVEKPLISGIAFNRDEAKLTVKGVPDKPGVAYQILGPVAHANIEVDMIVQNVAEDATTDFTFTVHRNDYRKALDILQATCTALGAREVTGDDKIVKVSLVGVGMRSHAGIAARMFEALAREGINIRMISTSEIKISIVVDEKYLELAVRTLHEAFNLDREPDAV

SEQ ID NO: 141 - DNA, 1311 bp, Artificial sequence
  Synthetic construct
  CDS (1)..(1311): Homoserine dehydrogenase MCA0597
ttgaacccggtaaaaatcggcatcctcggcctcggcacggtcggcggcggcacggtcaacgtgttgcggcgcaatgccgacgaaatcacccgccgcgccggccgcgagatccaggtctgccgcgcctcgacccgcgacctgacgcgctcccgcatctgcgacaccaccggcatcgccctgaccgacgatccctacgagatcgtctccgaccccgacatccagatcgtggtcgagaccatcggcggcgagacgccggcgcgggatctggtcatgaaggcgctggcaaacggcaagcacgtcgtcaccgccaacaagatgctgatcgccctgcacggcaacgaaatcttcgccgccgcccgcgaacgcggcctgatggtcgccttcgaagccgccgtggccgggggcatccccatcatcaagaccatccgcgagggactggcgggcaacaaggtcgaatggctggccggcatcatcaacggcaccagcaacttcatcctcaccgagatgtgggaaaagggccgcgacttcgccgacgtcctgcaggaagcccagcggctgggctacgccgaagccgatccgaccttcgacatcgagggggtggacgccgcccacaagctcaccatcctggcatcgatcgccttcggcatcccgctccagttcggcaaggtctacatcgagggcatcaccggcatcaccgcggccgacgtcaaatacgccgaggcactgggttaccgcatcaaactgctcgggatcgcccgccgcacccccaagggcatcgaactgcgggtccaccccaccttgattccggcgcgccggctgatcgccaacgtcaacggtgtgatgaacgccgtactgatcaagggcgacgccgtggggcccaccctgcactacggcgcgggcgccggggccgaaccgaccgcctccgcggtggtcgccgatatcgtcgacgtggtccgcaccctgacctccgatcccgaaaaccgggtgccacacctggccttccagcccgccgcgatctccgagatcccgatcctgccgatcgaagcgatcgagaccgcctattacctgcggctctctgccgaggacaagcccggggtgctggccgacgtgacccgcatcctcgccgcccaccacatcagcatcgaagccgtgctgcagaaggagatgccggagggcgagagccatctgccagtgatcatgctgacgcagaaggtcaccgagcgcgaacttaacgccgccgtgcgggaaatcgaggcgctaccgacgatcaagggcgcggtcaaacgcatccggctcgaaacgctgggttga

SEQ ID NO: 142 - protein, 436 aa, Artificial sequence
  Synthetic Construct
LNPVKIGILGLGTVGGGTVNVLRRNADEITRRAGREIQVCRASTRDLTRSRICDTTGIALTDDPYEIVSDPDIQIVVETIGGETPARDLVMKALANGKHVVTANKMLIALHGNEIFAAARERGLMVAFEAAVAGGIPIIKTIREGLAGNKVEWLAGIINGTSNFILTEMWEKGRDFADVLQEAQRLGYAEADPTFDIEGVDAAHKLTILASIAFGIPLQFGKVYIEGITGITAADVKYAEALGYRIKLLGIARRTPKGIELRVHPTLIPARRLIANVNGVMNAVLIKGDAVGPTLHYGAGAGAEPTASAVVADIVDVVRTLTSDPENRVPHLAFQPAAISEIPILPIEAIETAYYLRLSAEDKPGVLADVTRILAAHHISIEAVLQKEMPEGESHLPVIMLTQKVTERELNAAVREIEALPTIKGAVKRIRLETLG

SEQ ID NO: 143 - DNA, 1068 bp, Artificial sequence
  Synthetic construct
  CDS (1)..(1068): Homoserine O-succinyltransferase (metA) MCA1876
atgccgctggttgcacacaccgatctgcccaccttccagcgtctgcgcgaggagggccaggacgtcctcagcgtcgaacgcgccgcccggcaggacatccgtgagatgcacatcggtcttctgaacatgatgccggatgccgccctggaagccaccgagcggcagttcttccggctggtggggggagccaatccgatcgtgcagttccacatgcatccgttcaccatcgagggattgccgcggggagaccaggcggcggagcacatcgcccgctattacgagagcttcgaccgtatccgcgaggagggcctcgacggtctgatcgtgagcggggccaacgtcacccagccacatctgcagcaggaagcgttctggcagccgctgaccgaggttttcgactgggcccgcagcaacgtcacttcgatcctgtgctcgtgtctcgccacccatgccctgttccagtacagctacggcgtggagcgcacccatctcggtttcaaacgctggggcgtctattcgcaccgggtggtcgagccgctgcatcccctggtggcggacatcaacacccgcttcgacgtgccgcattcgcgctacaacgaaatcttccgcgaggacatggaggccgcggggctgcgggtcctggtcgagagcgaggaagccggggtacacctcgcggtgagcccggacctgttccgcgtcatctacttccaggcccatccggaatacgacaccgtgagtctgcttaaggaatacaagcgcgaaatcctgcgttacttttccggcgagcgcgaggactacccgccctttcctgaacactatttctcgctcgaagtgggcgcggcgctcaatgactacggccaggcgctgcgcagcgcccgccgggcgggcagggcgccgccgccgtttccggaggaattcgtgctaaggcacctggacaacacgtggcgcgataccgccaaggcagtgttcaacaactggctgggaaaaatctaccagatcaccgaccaggaccgccgcaagcccttcatggctcacatcgatccggacaatccgctgggactggcatag

SEQ ID NO: 144 - protein, 355 aa, Artificial sequence
  Synthetic Construct
MPLVAHTDLPTFQRLREEGQDVLSVERAARQDIREMHIGLLNMMPDAALEATERQFFRLVGGANPIVQFHMHPFTIEGLPRGDQAAEHIARYYESFDRIREEGLDGLIVSGANVTQPHLQQEAFWQPLTEVFDWARSNVTSILCSCLATHALFQYSYGVERTHLGFKRWGVYSHRVVEPLHPLVADINTRFDVPHSRYNEIFREDMEAAGLRVLVESEEAGVHLAVSPDLFRVIYFQAHPEYDTVSLLKEYKREILRYFSGEREDYPPFPEHYFSLEVGAALNDYGQALRSARRAGRAPPPFPEEFVLRHLDNTWRDTAKAVFNNWLGKIYQITDQDRRKPFMAHIDPDNPLGLA

SEQ ID NO: 145 - DNA, 1152 bp, Artificial sequence
  Synthetic construct
  CDS (1)..(1152): O-succinyl-L-homoserine sulfhydrylase (metZ) MCA2488
atggagacccgggccgtgcgcgccgggcaacggcggacgatggagcaggagcatgcggagccgatcttcgccacttccagctacgtgttcgccagcgccgccgaggcggccgagcgcttcgccggcaaggcggcgggcaacatctactcacgcttcacgaatcccacggtgcggaccttcgaggagaggctggcggcgctggagggcggggagcgctgcgtcgcggtcggctccggtatggcggccattgccagtaccgcgttcgggttgctgaaggcaggcgatcacgtggtgtgttcgcgcagcgtgttcggcaataccaccctgctgttccagaattacctggccaagttcggggtcccgacgaccttcgtcggtctcaccgattacgatggctgggcagcggccatccggcccgagacccggtttctgttcatcgagacgccttccaatccgctgaccgaaatcgccgacatcccaaggctcgcggaaatcgcccactcccgcggctgcctgctggtggtggacaattgtttctgcaccccggccttgcagaggccgctggcgctgggtgcggacatcgtgatccattcggccaccaagtacctcgacgggcagggccgctgcgtaggcggggccatcgtcggcgggcgcgaactgctcgacgccgaaatctacccattcctgcgcaccggcggccccagcatgagtccgttcaacgcctgggtgttcctcaagggattggaaacgctgaatctcaggatgaaagcccattgtgagaacgcactcggcctggcccgctggttggaggcgcagccctgggtcgagcgggtgcattatccgggactcgccagccatccccagcatgaactcgccgcccgccagcaatcgggtttcggcggcatcgtcagcttcgaggtcaagggcggacaggaggctgcctggcgtctgatcgacagcacccggctgctgtcgatcaccggcaatctgggcgatgccaaaaccaccatcacccatccggcgactaccactcacggccgtctgagtccggaagcccgggcagcggccggtatcgccgacgggctgatccgcatcgcggttggactggagaacctcgccgatattcaggccgatctggctcgcttcgcctga

SEQ ID NO: 146 - protein, 383 aa, Artificial sequence
  Synthetic Construct
METRAVRAGQRRTMEQEHAEPIFATSSYVFASAAEAAERFAGKAAGNIYSRFTNPTVRTFEERLAALEGGERCVAVGSGMAAIASTAFGLLKAGDHVVCSRSVFGNTTLLFQNYLAKFGVPTTFVGLTDYDGWAAAIRPETRFLFIETPSNPLTEIADIPRLAEIAHSRGCLLVVDNCFCTPALQRPLALGADIVIHSATKYLDGQGRCVGGAIVGGRELLDAEIYPFLRTGGPSMSPFNAWVFLKGLETLNLRMKAHCENALGLARWLEAQPWVERVHYPGLASHPQHELAARQQSGFGGIVSFEVKGGQEAAWRLIDSTRLLSITGNLGDAKTTITHPATTTHGRLSPEARAAAGIADGLIRIAVGLENLADIQADLARFA

SEQ ID NO: 147 - DNA, 2289 bp, Artificial sequence
  Synthetic construct
  CDS (1)..(2289): Homocysteine transmethylase (metE)  MCA2260
atggcagtcacacattccctgggatttccccgcatcggcgccgggcgcgaactgaagcgggccgtcgaagcctgttgggccggccggaccggcccggcggaattggcgcagaccggccgggagttgcgcgagcggcactggatgatccagagcggttccggcatcgacctggtgccggtcggcgatttcgcctggtacgaccagatgctgaacatgacggcgctgctgggagcggtgccccggcgtttcggtttccaggccgatgccctgagcctggaccagtatttccagctcgcgcggggcaatgccgaacagccggcgatggaaatgaccaagtggttcgataccaactaccactacatcgtccccgagttcgaccgggagaccggcttcggtccgggcacggaatggctgttcgacgaagtggaggaggccaaggcgctgcggctcaatcccaagccggtcctgatcgggcctctgacctatctccatctgggcaaggaaaggcaggccggcttcagccgcctggaactcctgccccggctgctgccggcctatgccgcgatcctgcggcgactgcatgcctcgggtgtgccctgggtgcagatggacgaaccgatcctggggatggatctgccgccggaatggctcgaagccttcgcgccggcctatgccgccctggcggaagccggtcccaagctgctgctggcgacttatttcgcttcggtggcggagcacgcggtatggctcaagtcctcggcggtcgccgggctgcacatcgacgcggtgcgggcgcccgaacaggtcgccgatttcctgaaggatttcccggcggacaaggtgctttccctgggactgatcgacggccgcaacgtctggcgcaccgacctgcgccgcgcgctggagcaggcggaaagcgccggtgcggtgctgggggagagactgtggctggcgcccagctgctccctgctgcacgtgccgcaggatctctcgctggaaacctcgctgaatcccgagatcaaggactggctcgccttcgccgtgcagaagctggaagagctggccgtgatcgacaaaggcctgcggctggggcggcaggccgtcgccgcggaactcgccgagcgggatcgcctgctgcagacccgggcgcaatcgccgctgattcatgatccaggcgtcaaacggcggctggagggtctgagcgatgccgatttccgccgccactcgccgttcgccgagcgcagcccgctgcagcgcgagcggctgcgcctgccgccgtttcccaccaccaccatcggctcctttccccagacaccgaagatccgcgcggcgcgtgccgcccaccgccgcggcgagttgaacggggacgcctaccgggatgcgatgcgggccgccatccgcgaggccgtgtacaaacaggagtcgctggggctggacctgctggtgcacggcgaggccgagcgcaacgacatggtggagtatttcggcgaacggttggccggctacgccttcaccaagcacggctgggtgcagagctacggatcccgctgcgtcaagccgccgatcatctacggcgatgtggcgagacccgagccgatgacggtggaatggatcggctatgcccagagtctgacgaaaaagcccgtcaaaggcatgctgaccgggccggtgacgatgctgcaatggtcattcgcgcgcgacgaccagccgcgtgcggtgaccgccctgcagatcgcactggcgatccgggacgaggtcgccgacctggaggccgccggcgtggctgcgatccagatcgacgagccggctttccgcgaggggctgccgctcaaggccgcagaccgggccgattatctggactgggcagtcaaggcgttccggctcgcctcctgtggcgtcgccgacgacacccagatccacacccacatgtgctactcggagttcggcgacatcctgccggccatcgccgagctggatgccgacgtcatcaccatcgaaacctgtcgctcggcgatggacctgctggaagccttcggcgccttcggctatcccaacgacatcggtcccggcgtctacgacatccattcgccgcgggttccggccggcgccgagatacgggcgctgttggaaaaggccgctgcggcggtcgatccggagcggttgtgggtcaatccggactgcggcctgaagacccgccagtggccggaagcggagcaggcgctggcgaacatggtcgaagcggccagggcgatgcgaagagccgaatcgctggccggatcggcggcttga

SEQ ID NO: 148 - protein, 762 aa, Artificial sequence
  Synthetic Construct
MAVTHSLGFPRIGAGRELKRAVEACWAGRTGPAELAQTGRELRERHWMIQSGSGIDLVPVGDFAWYDQMLNMTALLGAVPRRFGFQADALSLDQYFQLARGNAEQPAMEMTKWFDTNYHYIVPEFDRETGFGPGTEWLFDEVEEAKALRLNPKPVLIGPLTYLHLGKERQAGFSRLELLPRLLPAYAAILRRLHASGVPWVQMDEPILGMDLPPEWLEAFAPAYAALAEAGPKLLLATYFASVAEHAVWLKSSAVAGLHIDAVRAPEQVADFLKDFPADKVLSLGLIDGRNVWRTDLRRALEQAESAGAVLGERLWLAPSCSLLHVPQDLSLETSLNPEIKDWLAFAVQKLEELAVIDKGLRLGRQAVAAELAERDRLLQTRAQSPLIHDPGVKRRLEGLSDADFRRHSPFAERSPLQRERLRLPPFPTTTIGSFPQTPKIRAARAAHRRGELNGDAYRDAMRAAIREAVYKQESLGLDLLVHGEAERNDMVEYFGERLAGYAFTKHGWVQSYGSRCVKPPIIYGDVARPEPMTVEWIGYAQSLTKKPVKGMLTGPVTMLQWSFARDDQPRAVTALQIALAIRDEVADLEAAGVAAIQIDEPAFREGLPLKAADRADYLDWAVKAFRLASCGVADDTQIHTHMCYSEFGDILPAIAELDADVITIETCRSAMDLLEAFGAFGYPNDIGPGVYDIHSPRVPAGAEIRALLEKAAAAVDPERLWVNPDCGLKTRQWPEAEQALANMVEAARAMRRAESLAGSAA

SEQ ID NO: 149 - DNA, 3714 bp, Artificial sequence
  Synthetic construct
  CDS (1)..(3714): Methionine synthase (metH) MCA1545
atgaatctccccgttactgccatggagcgttcgtcgctcctaaaacgtctgctcaaggaacgcatcctgtttctcgatggcgccatgggtacgatgattcaacgctacaagctggcggaggccgactaccggggccagcgcttcgccgattggccgcgggacctgaagggcaacaacgacctcttgtcgctgacccgtccggacgtgatcgaggccatccactgggcttatctggaagcgggggccgacatcgtggaaaccaacagcttcaatgccacccgcatcagcatggcggattacggcatggagccgctggtctacgagatcaacgtggcttcggcccggctggcccggcaggtggcggaccgtatgagccggcagacgccggaccggccgcgtttcgtcgccggggtcctgggaccgaccagccggaccgcctcgatatcgccctcggtcaatgatccaggtttccgcaacatcggcttcgacgaactggtggcgtcctacgacgaggccgtacgcggcctggtcgatggtggtgccgacatcattctgatcgagacgatcttcgacactctcaatgccaaagcggccgtattcgccgtcgagcggttcttcgagcaagagggctacaccctgccggtgatgatctccggcaccattaccgatgcctcgggccgcacgctgtcggggcagactaccgaggccttctggaattcactgcgccacgccaggccgatttcgatcggcctcaattgcgcactcggggccaaacagctccgccagcacgtcgaggaactctcgcgcatcgccgacacgtacgtctccgcacatcccaatgccggcctgcccaacgagttcggcgaatacgacgaatcacccgaagcgatggcccgcgagatcgccgactgggccgagcagggtttcctcaacatcatcggtggctgctgcggtaccacgccggcacacatcgaggcaatccacgacgcggtccagcatttcccccctcggcgcatcccggagataccgccggcctgccggctggccggcctggaaccctgcaacatcacggcgggctcactgttcgtcaacgtcggtgaacgtaccaacgtgacgggttcggcggcatttcggcgcatgatccgggaggcgaagtatgatgaagccctggaagtggcgcgccagcaggtcgagagcggagcccagatcatcgacgtcaacatggacgagggcatgctcgattcgagggcagcgatggtgcagtttctcaacctcatcgccgcggaacccgacatcgcccgcgtgccggtgatgatcgattcctccaagtgggagatcctggaggctggcctcaagtgcctccagggcaagggtatcgtcaactcgatctcgctcaaggaaggggaggcggcttttctccaccatgcccggttggtgcggcgttacggcgcggctgtcatcgtcatggctttcgacgaacagggccaggccgacacccgcgagcgtaaggtcgagatctgcgagcgggcttaccggctgctgactgaaaaggccggcttcccggccgaggacatcatcttcgatcccaacatcttcgcggtggcgaccggcatcgaggaacacgaccgctatggtctcgatttcatcgaggccgtggccgaaatcaagtctcggctgccgcatgcgctggtctcggggggggtgtcgaacgtctccttctcgttccgcggcaacgatgcggtgcgtgaggccatccacgcggtgttcctataccacgccattcgcgcggggatggacatggggatcgtcaacgccggtcagctcgcgatctacgaggaagtgccggaggaactgcgcgacgccgtggaggacgtcatcctcgcccgccgtgaggatgccaccgagcgcctgctcgccattgccgaccgttaccggggcgaggagggcgcaggtagcgagcgcaaggccgatatggcctggcgctcgctgccggtggacaagcgcctggaacatgcgctggtcaaaggcatcgacgagttcatcgaggtcgatacggaagaagcgcgccggcagttcgaacggccgctgcacgtcatcgaaggaccgctgatggccggtatgaacgtggtcggcgatttgttcggcgccggcaagatgttcctgccccaggtggtcaaatcggcgcgggtgatgaagaaggccgtggcctatctgatgccttacatggacgccgagaaggctggaaccgaggtcggcaccaacggcaaaatcctcatggcgacggtgaagggcgacgtgcacgacatcggcaagaacatcgtcggcgtggtgctccagtgcaacggtttcgaagtgatcgatctgggcgtcatggtaccctgcgacaagattttgcagaccgcccgtgaggaaaacgtcgacatcatcggcttgtccgggctgatcacgccctcattggatgagatggtccatgtcgccagggaaatggagcggctcggtttcgaaattccgctcatgatcggcggcgccacgacgtcccgagcgcacacggccgtcaagatcgagcccaattaccatgggccgaccgtctatgtgaccgacgcctcgcgcagcgtcggcgtggcgggcagtctgctcagtgccgacctgaaggacgaattcacggcccggctgcgcaaggaatacgaagaggtacggcggcatcatgccggacgccgcatccagggtacgttgctgagcctgcagcaggcgcgggccagggccttccatacggactgggcgcattacgtaccgccggcgccgcatctgctgggtctggaagtgttcgacgcctaccccctggaagagatcgccggatacatcgactggtcaccgttcttccatacctgggagctggccggcagctatccaaggatattggacgacgaggtggtaggggaacacgcccgcacactgctgcaggatgcccgtgccatgctggcgctcttgaccgaacagcgctggctcaccgctcgtggcgtgatcggattttttccagccaattcggaaggggatgacgtcgtgctgtggaccgacgaaagccggaccgagcggctggcggtgttgcatcatctgcgtcagcagcaggacaagccgggggggcagcccgcatactgtctggcggatttcgtcgcgccggtcggcagcggggtggccgactacctgggcggattcgccgtgaccgttggccatggcatcgaggcgccgttggagcggttcgcccgggtccatgacgactacagcggcatcatgctgaaggcgcttgccgaccggctggccgaggccttcgcggaacggatgcaccagcgggtgcggcgtgagttctggggttatgcgccggaggaatcgctggacaacgaggcgctgatcgccgaggcgtatcgcggcatccggccggccccgggttacccggcctgtcctgatcacaccgagaaggccacgctgttccgcctgttggatgccgaagccaactccggcatttcactgaccgaaagcttcgccatgtatccggcttcctcggtcagcggctggtatttttcgcatgcttcggcaaagtacttcaacgtcggtaagatcggccgcgaccaggtcgaagattacgctcggcgcaaggggatgacggtacgcgaggtcgagcgctggctggcgtcgagtctcggctacgatgccgattga

SEQ ID NO: 150 - protein, 1237 aa, Artificial sequence
  Synthetic Construct
MNLPVTAMERSSLLKRLLKERILFLDGAMGTMIQRYKLAEADYRGQRFADWPRDLKGNNDLLSLTRPDVIEAIHWAYLEAGADIVETNSFNATRISMADYGMEPLVYEINVASARLARQVADRMSRQTPDRPRFVAGVLGPTSRTASISPSVNDPGFRNIGFDELVASYDEAVRGLVDGGADIILIETIFDTLNAKAAVFAVERFFEQEGYTLPVMISGTITDASGRTLSGQTTEAFWNSLRHARPISIGLNCALGAKQLRQHVEELSRIADTYVSAHPNAGLPNEFGEYDESPEAMAREIADWAEQGFLNIIGGCCGTTPAHIEAIHDAVQHFPPRRIPEIPPACRLAGLEPCNITAGSLFVNVGERTNVTGSAAFRRMIREAKYDEALEVARQQVESGAQIIDVNMDEGMLDSRAAMVQFLNLIAAEPDIARVPVMIDSSKWEILEAGLKCLQGKGIVNSISLKEGEAAFLHHARLVRRYGAAVIVMAFDEQGQADTRERKVEICERAYRLLTEKAGFPAEDIIFDPNIFAVATGIEEHDRYGLDFIEAVAEIKSRLPHALVSGGVSNVSFSFRGNDAVREAIHAVFLYHAIRAGMDMGIVNAGQLAIYEEVPEELRDAVEDVILARREDATERLLAIADRYRGEEGAGSERKADMAWRSLPVDKRLEHALVKGIDEFIEVDTEEARRQFERPLHVIEGPLMAGMNVVGDLFGAGKMFLPQVVKSARVMKKAVAYLMPYMDAEKAGTEVGTNGKILMATVKGDVHDIGKNIVGVVLQCNGFEVIDLGVMVPCDKILQTAREENVDIIGLSGLITPSLDEMVHVAREMERLGFEIPLMIGGATTSRAHTAVKIEPNYHGPTVYVTDASRSVGVAGSLLSADLKDEFTARLRKEYEEVRRHHAGRRIQGTLLSLQQARARAFHTDWAHYVPPAPHLLGLEVFDAYPLEEIAGYIDWSPFFHTWELAGSYPRILDDEVVGEHARTLLQDARAMLALLTEQRWLTARGVIGFFPANSEGDDVVLWTDESRTERLAVLHHLRQQQDKPGGQPAYCLADFVAPVGSGVADYLGGFAVTVGHGIEAPLERFARVHDDYSGIMLKALADRLAEAFAERMHQRVRREFWGYAPEESLDNEALIAEAYRGIRPAPGYPACPDHTEKATLFRLLDAEANSGISLTESFAMYPASSVSGWYFSHASAKYFNVGKIGRDQVEDYARRKGMTVREVERWLASSLGYDAD

SEQ ID NO: 151 - DNA, 2127 bp, Artificial sequence
  Synthetic construct
  CDS (1)..(2127): S9A family peptidase (codon optimized nucleic acid)
atgtggtcgcacccccaattcgagaaggccagcccgtacccgtacgacgtcccagactatgctggctcccagaatagcaacagtctgaagtatccggaaaccaagaaagtcagccacaccgacacttacttcggcacccaggtttcagacccgtatcggtggctggaagatgaccgtgcggaagataccaaggcgtgggtccagcaagaggtgaagttcactcaagactatctcgctcagatccccttccgcgaccaactgaagaagcaactgatggacatttggaattacgagaagatctcagcgcccttcaagaagggcaagtacacctacttctccaaaaatgacggcctccaggcacagagtgtcctctacaggaaggacgctgcgggtaagacggaagtgttcttggacccgaataagttttccgagaagggcaccaccagcctggcgtccgtctcgttcaataagaagggcaccctcgtcgcctatagcatttccgagggcggcagtgactggaataagattatcattctcgacgcggagacaaagaagcagctggacgaaaccctgctcgacgtcaaattctcgggcatctcctggctgggcgacgaaggtttcttctattcctcctacgacaagcccaaagagggctccgtgctcagcggcatgaccgacaagcataaggtgtattttcataagctcggcaccaagcaatcgcaggacgaactcatcatcgggggagacaagttcccgcgacggtatatcggggcatacgtaaccgacgaccagaggtacctggttgtgagtgcggccaacgcgaccaacggcaacgagctgtacatcaaggacctgaagaacaagacggactttatccccatcatcacgggcttcgactccaatgtgaatgtggccgacaccgacggtgacaccctctatcttttcacggacaaggacgcgccgaataagcgccttgtcaagaccaccatccagaatccgaaggccgagacgtggaaggacgtgatcgccgagacatccgagccgctggagatcaataccggtggtggttacttcttcgcaacctatatgaaggacgccatcgaccaagtgaagcaatacgacaagaatggcaagctggtgcgcgccatcaaactgccaggcagcggaaatgcgtcgggcttcggcggtgagaaaacagaaaaggacctttactattcgttcaccaactatatcaccccgcctaccatcttcaagtacaacgtcacgaccggcaattcggaagtgtatcagaagccgaaggtcaagttcaatcccgagaattatgtgtctgaacaggtgttctacacgagctccgacggcaccaagatcccgatgatgatctcgtataagaagggcctcaagaaggacggcaagaatcccacgatcctttactcatacggcggcttcaacatctctctccagccggcgttcagcgtagtcaacgcgatctggatggagaatggcggcatctacgcggtcccgaatatccgcggtggcggtgaatacggcaagaaatggcacgacgccggaaccaagatgcagaagaagaatgtgttcaatgactttattgcagcgggggagtatcttcagaagaatggctatacgtccaaagagtacatggcgctcagcggtagggcgaatggtgggttgctcgtgggcgccaccatgacgatgcgcccagacctggccaaagtcgccttcccgggagttggcgtgctcgacatgctgcgctacaataagttcaccgctggcgcaggctgggcttatgactatggcaccgcggaagattcgaaagagatgttcgagtatctcaagtcgtacagcccggtgcataatgtcaaggcgggaacgtgctatccgagcacgatggttatcaccagcgaccatgacgaccgcgtggtccctgcccactcgttcaagttcgggtccgaactccaggcaaagcaaagctgcaagaacccgatcctgatccggatcgaaaccaatgccggtgcgggtgctggacgctcgaccgagcaagtggtcgcggaaaatgccgacctgttgagcttcgccttgtatgaaatgggcatcaaaagcctgaaactc

SEQ ID NO: 152 - protein, 709 aa, Artificial sequence
  Synthetic Construct
MWSHPQFEKASPYPYDVPDYAGSQNSNSLKYPETKKVSHTDTYFGTQVSDPYRWLEDDRAEDTKAWVQQEVKFTQDYLAQIPFRDQLKKQLMDIWNYEKISAPFKKGKYTYFSKNDGLQAQSVLYRKDAAGKTEVFLDPNKFSEKGTTSLASVSFNKKGTLVAYSISEGGSDWNKIIILDAETKKQLDETLLDVKFSGISWLGDEGFFYSSYDKPKEGSVLSGMTDKHKVYFHKLGTKQSQDELIIGGDKFPRRYIGAYVTDDQRYLVVSAANATNGNELYIKDLKNKTDFIPIITGFDSNVNVADTDGDTLYLFTDKDAPNKRLVKTTIQNPKAETWKDVIAETSEPLEINTGGGYFFATYMKDAIDQVKQYDKNGKLVRAIKLPGSGNASGFGGEKTEKDLYYSFTNYITPPTIFKYNVTTGNSEVYQKPKVKFNPENYVSEQVFYTSSDGTKIPMMISYKKGLKKDGKNPTILYSYGGFNISLQPAFSVVNAIWMENGGIYAVPNIRGGGEYGKKWHDAGTKMQKKNVFNDFIAAGEYLQKNGYTSKEYMALSGRANGGLLVGATMTMRPDLAKVAFPGVGVLDMLRYNKFTAGAGWAYDYGTAEDSKEMFEYLKSYSPVHNVKAGTCYPSTMVITSDHDDRVVPAHSFKFGSELQAKQSCKNPILIRIETNAGAGAGRSTEQVVAENADLLSFALYEMGIKSLKL

SEQ ID NO: 153 - DNA, 2127 bp, Artificial sequence
  Synthetic construct
  CDS (1)..(2127): S9A Family Peptidase (codon optimized nucleic acid)
atgtggtcccacccccagttcgagaaggcgtccccgtatccctacgatgtcccggattacgccggcagccaaaacagtaactcgctcaagtatccggagacgaagaaagtgtcccataccgatacctatttcggcacccaggtgtcggatccgtaccgctggctggaagatgatcgcgccgaggatacgaaggcgtgggtacagcaagaggtcaagttcacccaagactacctcgcacagatcccctttagggaccagctgaagaagcaactgatggatatttggaattatgagaagattagcgcaccgttcaagaaggggaagtacacgtatttcagtaagaatgacggcctccaggcacaatcggtgctttaccgcaaggatgcagcgggaaagactgaggtattcctcgatcccaacaagttctcggagaagggcaccacgtcgctcgcatccgtctccttcaataagaagggcaccctggtggcctacagcatctctgagggcggatcggattggaacaagatcatcatcctcgacgccgaaaccaagaaacagctggacgagacgctgctggatgtgaaattctccggcatctcgtggctgggcgacgagggtttcttctattccagctatgacaagccgaaagagggcagcgttctctccggcatgacagacaagcataaggtgtatttccacaagctgggcacgaagcagtcgcaggacgagctgatcatcggcggtgacaagttcccgcgtcggtatatcggcgcgtatgtcacagacgaccagcgttacctggtcgtgtcggcagcgaacgccacgaacggcaacgagctctacattaaggacctcaagaacaagacagatttcatcccgatcattaccgggttcgacagcaatgtcaacgtcgcggataccgacggcgacacgctctacctgttcacggacaaggacgcgccgaacaagcgcctggtcaagactaccatccagaatcctaaggctgagacgtggaaagatgtaatcgcggagacgtccgagccgcttgagatcaacaccggtggtgggtatttcttcgccacgtacatgaaggacgccatcgaccaggtgaagcagtatgacaagaatggcaagctcgtgcgggcaatcaagctccctggttccggcaacgcgagcggctttggcggggagaaaacggagaaggatctgtactactcgttcacaaactatatcaccccgccaaccatcttcaagtacaatgtcaccaccggcaactccgaggtctatcagaaaccgaaggtgaagttcaatccggagaactacgtaagcgagcaagtgttctatacctcgtccgacggcacgaagatcccgatgatgatttcgtacaagaagggtctgaagaaggacggcaagaatcctaccatcctctattcgtacggcggcttcaacatctcgctccaaccggcgttctcggtcgtcaacgcgatctggatggagaatggcggcatctacgctgtcccgaacatccgcggtggcggagagtatggtaagaagtggcatgacgccggtaccaagatgcaaaagaaaaacgtctttaacgacttcatcgcggcaggggagtatcttcagaagaatggctatacttcaaaagagtacatggccctgagcggtagggcgaacggtggcctgctggtcggcgcgaccatgaccatgcgtccggatttggcgaaggtcgcgttccctggggtcggcgtcctcgacatgctgcgctacaacaagtttactgcaggcgcaggctgggcgtacgactatggtaccgccgaagattccaaagagatgttcgagtaccttaagagctattcgccggtgcataacgtcaaggcgggcacgtgctatcccagcacaatggtgatcacctccgaccatgacgatcgcgtggttccggcgcatagtttcaagttcggatcggagctgcaagcgaaacagagttgcaagaatcccatcctgatccggatcgaaaccaacgcaggagcgggtgccggcaggagtaccgaacaggtcgtggcggagaacgcggacctcctctccttcgcactctacgagatgggcatcaagtccctcaagctg

SEQ ID NO: 154 - protein, 709 aa, Artificial sequence; identical to SEQ ID NO: 152
  Synthetic Construct

SEQ ID NO: 155 - DNA, 2127 bp, Artificial sequence
  Synthetic construct
  CDS (1)..(2127): S9A family peptidase (codon optimized nucleic acid)
atgtggtcgcacccccaattcgagaaggcgagcccgtacccgtacgacgtccccgactacgcgggcagccagaactccaacagcctgaagtacccggagacaaagaaagtatcgcatacggacacctacttcggcacgcaagtatcagacccgtatcgctggctggaagatgacagggccgaggacaccaaggcgtgggtgcaacaagaggtcaaattcacccaggactacctggctcagattccctttcgcgaccagctgaagaagcagctcatggacatctggaattatgagaagatctccgctccgttcaagaagggtaagtacacctatttctcgaagaatgacggcctgcaggcgcagagcgtcctttaccggaaggacgcggctggcaagaccgaggtgttcctggaccccaacaagttctccgagaaaggcaccaccagtctcgcgtccgtcagtttcaataagaagggcaccctggttgcctattcgatctccgagggcggctcggactggaacaagatcatcatcctggacgcggagacgaagaagcaacttgacgagacgctgctggacgtcaagttctccggcatctcctggctgggcgacgagggcttcttctattcgtcgtacgacaagcccaaagagggcagcgtcctgtccggcatgaccgacaagcataaggtctacttccacaagctgggcaccaagcagtcccaagacgagcttatcatcggcggtgacaagttccctcggcgctacatcggcgcgtacgtgacggacgaccaacgctacctcgtcgtctccgctgccaacgcgaccaatgggaacgagctctatatcaaggacctcaagaacaagaccgacttcatcccgatcatcaccggcttcgacagtaacgtgaacgtcgcggacacggacggggacaccctctaccttttcaccgacaaggacgccccgaataagcgtctcgttaagaccaccatccagaatccgaaggcggagacgtggaaggacgtgatcgcggagacgtcggagccgctggagatcaataccggtggcgggtacttcttcgcgacctatatgaaggacgcgatcgaccaggtgaagcagtatgacaagaatggcaaactggtgcgtgcgatcaagctgccgggcagcggcaacgcgagcggctttggcggcgagaaaaccgagaaggacctctactatagtttcacgaactacatcaccccgccaaccattttcaagtataacgtcacgacgggcaacagtgaggtgtatcagaagccgaaagtcaagttcaatccggagaactacgttagcgaacaggtattctacaccagcagcgacggcaccaagatccccatgatgatctcatacaagaaggggctcaagaaggacgggaagaaccccactattctctatagttacggcggctttaacatctccctgcagccggcgttcagcgtggtgaacgcgatttggatggagaatggcgggatctacgcggtcccgaatattcgtggcggtggtgagtatggcaagaaatggcatgacgcggggacgaagatgcagaagaaaaacgtattcaatgactttatcgctgcgggcgagtacctccaaaagaacggctatacctccaaagagtatatggcgctcagcggcagggccaacggcggtctgctggtcggcgccacgatgacgatgaggccggacctcgccaaggtcgcgtttccgggcgtgggcgtgctggacatgctccgctataacaagttcaccgctggcgcaggctgggcctacgactacggaacggcggaagattcgaaagagatgttcgagtaccttaagtcctatagtccggtccataacgtgaaggcgggcacttgctaccccagcacgatggtcatcacctcggaccatgacgaccgcgttgtcccagcgcattctttcaagttcggctcggagctccaagcgaagcagagctgcaagaacccgatcctgatccggattgagacgaacgcgggtgcgggtgcaggccgctccaccgaacaggtcgtggcggagaacgcggacttgctgagcttcgcgctctacgagatgggcatcaagagcctgaagctc

SEQ ID NO: 156 - protein, 709 aa, Artificial sequence; identical to SEQ ID NO: 152
  Synthetic Construct

SEQ ID NO: 157 - DNA, 2127 bp, Artificial sequence
  Synthetic construct
  CDS (1)..(2127): S9A family peptidase (codon optimized nucleic acid)
atgtggagccacccccaattcgagaaagcatcgccctacccgtacgacgtgcccgactacgcgggcagccagaactcgaactcgctgaaatatcctgagacgaagaaagtgtcccatactgatacgtatttcggcacccaggtgtcggacccgtaccgctggcttgaggacgaccgggcagaggacaccaaagcctgggtgcagcaagaggttaagttcacccaggactatctggcccaaatcccgtttcgcgaccagctgaagaaacagctgatggacatctggaactacgagaaaatctcggcaccctttaagaaagggaagtatacctatttcagcaaaaatgacggccttcaggcgcagtcggtgctctatcgcaaagacgcagcgggcaagaccgaggtgttcctggacccgaacaaattctcggagaaaggcaccacctcgctcgcctcggtgagcttcaataagaaaggcaccctcgtggcgtactcgatctccgagggcggcagcgactggaacaagatcatcatcctcgacgcggagacgaaaaagcagctggacgagacgctgctggacgtcaagttctccggcatctcctggctcggcgacgagggcttcttctactcaagctatgacaagccgaaagagggctcggtgctgtcgggcatgaccgacaaacataaggtctacttccataagctgggcacgaagcagagccaggacgagctgattatcgggggtgacaaattcccacggcggtatatcggggcctatgtgaccgacgaccagcgctatctggtggtgtcggcagccaatgcgaccaacggcaacgagctgtacatcaaagacctgaagaacaaaacggacttcatcccgatcattaccggcttcgacagtaatgtgaacgtcgcggacacggacggagacaccctctatctcttcaccgacaaagacgccccgaacaaacggctcgttaagacgaccatccaaaacccgaaagcggagacgtggaaggacgtgatcgccgaaacctccgagccgctggagatcaacaccggcggtggctactttttcgccacctatatgaaagacgccattgaccaggtaaagcagtatgacaaaaacggaaagctcgtacgggcgatcaagctccccggcagtgggaacgcgtcggggtttggcggcgagaaaaccgagaaagacctgtattacagtttcaccaactatatcacaccgcccaccatcttcaagtacaacgtcaccaccggcaatagtgaggtctaccagaaaccaaaggtcaaattcaacccagagaattacgtctcagaacaggtattctacacctctagcgacgggaccaagatcccgatgatgatctcgtataagaagggcctcaagaaagacggcaaaaacccgaccatcctgtactcctacggcggattcaacatcagcctgcagccggccttctcggtcgtcaacgccatctggatggagaacggcgggatctacgcggttcccaacatccgcggtggcggcgagtatggcaagaagtggcatgacgcgggcaccaaaatgcagaagaagaacgtattcaacgacttcattgcggctggtgagtacctccagaaaaatggctatacctcgaaagagtacatggccctctcgggacgtgcgaatggtggtctgctcgtgggcgcgacgatgaccatgcgtccggacctggccaaggtcgcgtttccgggcgtgggcgtcctggacatgcttcgctataacaagttcaccgcaggggcaggctgggcctacgactatggcaccgcggaagatagcaaagagatgttcgagtaccttaaatcctacagcccggttcataatgtcaaggcgggcacgtgctatccgtcgacgatggtgattaccagcgaccatgacgaccgcgtggtaccggcgcactccttcaaattcggatccgagttgcaggcgaaacagagttgcaagaatccgatcctgattcgtatcgagactaacgctggcgcaggagccggtcgctccaccgagcaagtggtcgcggagaatgccgacctcctctcgttcgcgctgtatgagatgggcatcaagagtctcaaactc

SEQ ID NO: 158 - protein, 709 aa, Artificial sequence; identical to SEQ ID NO: 152
  Synthetic Construct

SEQ ID NO: 159 - DNA, 2127 bp, Artificial sequence
  Synthetic construct
  CDS (1)..(2127): S9A family peptidase (codon optimized nucleic acid)
atgtggtcacaccctcaattcgaaaaagcatcgccctacccatacgacgttcccgactacgcaggatcccagaattctaattccctgaagtatccggagacgaagaaagtgtcgcataccgacacctatttcggcacccaggtgtcggacccgtataggtggctggaggacgaccgcgcggaggacaccaaggcatgggtacagcaggaagtgaaattcacgcaggactatctcgcgcagatccctttccgcgaccagctgaaaaaacagctgatggacatctggaattatgagaagatcagcgcgccgttcaagaaaggtaagtatacctacttctccaaaaacgacgggctgcaagcgcagtcggtgctgtatcgcaaagacgcggccggcaaaaccgaagtgttcctggacccgaataaattcagcgagaaggggaccacgtccctcgcgtccgtcagcttcaataagaaaggcacgctcgttgcatactcgatcagcgagggcggctccgactggaacaaaatcatcatcttggacgccgaaactaaaaagcagctggacgaaaccctcctcgacgtgaagttctccggcatctcgtggctcggcgacgagggcttcttctacagcagctatgacaagccgaaggaaggttccgtattgagcggcatgaccgacaaacataaagtgtatttccacaagctcggcaccaagcagtcccaagacgagttgatcatcggcggcgacaagttcccgcggcggtacattggcgcctacgtgacggacgaccaaaggtacctggtggtgagtgcagcaaatgcaacgaacggcaatgagctgtacatcaaagacctgaagaataagaccgactttatcccgatcatcactggctttgactccaatgtaaatgtcgcggacaccgacggcgacaccctctaccttttcacggacaaagacgcccccaataagcgcctcgtcaaaaccaccattcagaatccgaaggccgaaacgtggaaagacgtcatcgcggaaacttcggagccgctggagatcaataccggcggcgggtatttcttcgccacctacatgaaagacgcgatcgaccaagtgaaacagtatgacaagaatgggaaactcgtgcgggcgatcaagctgccgggttcgggcaatgcgtccggcttcgggggcgagaaaaccgagaaagacttgtactacagctttacgaactacatcacaccacccacgatcttcaagtataatgtgacgaccggcaactccgaggtgtaccagaaaccgaaggtcaagttcaaccctgaaaactacgtttccgaacaggtgttctataccagctcggacggcaccaaaatcccgatgatgatcagctataaaaaagggctcaagaaagacggcaaaaatccgacgatcctgtattcgtatggcggcttcaatatctccctgcagcctgccttctcggtggttaacgctatctggatggaaaatggcggcatctatgccgtgccgaatatccgcggcggcggcgagtacggtaagaagtggcacgacgcggggactaaaatgcagaaaaagaatgtgttcaatgacttcattgcagcaggcgaatatctccagaaaaatggctataccagtaaggaatacatggcactcagtggtcgggcgaacggcgggctgctcgtgggcgcgacgatgacgatgcgcccggacctcgcgaaggtcgcgtttccgggcgtgggcgtcctggacatgctgcgctataataaattcactgcgggtgcgggctgggcgtatgactacggcacggcggaggacagcaaggaaatgttcgaataccttaaatcgtattcccccgtgcataacgtaaaagccggcacgtgctacccgtcgaccatggtaatcacctcggaccacgacgaccgggtcgtgcccgcccattcgttcaaattcggctcggagctgcaggcgaagcagtcgtgcaagaatccgattttgatcaggattgaaaccaatgccggtgcgggcgcaggccgctcgacggagcaagtcgtggctgagaatgccgacctcctctcctttgccctttacgagatgggcatcaaatccctgaaactc

SEQ ID NO: 160 - protein, 709 aa, Artificial sequence; identical to SEQ ID NO: 152
  Synthetic Construct

SEQ ID NO: 161 - DNA, 2127 bp, Artificial sequence
  Synthetic construct
  CDS (1)..(2127): S9A family peptidase (codon optimized nucleic acid)
atgtggtcccatccgcagttcgaaaaagccagcccgtacccgtatgacgtacccgactacgcgggcagccagaatagcaattcgctgaaatatccggagacgaaaaaggtgagtcacacagacacctatttcggcacccaggtcagcgacccatatcgctggctcgaagatgaccgggctgaggacacgaaggcttgggtgcaacaggaagtgaagttcacgcaggactacctggcacagatccccttccgcgatcagctgaagaaacagctgatggatatctggaattacgagaaaatctccgcgcctttcaagaaaggcaaatacacctacttcagcaagaatgacggccttcaggcacagagtgtgctgtatcgcaaagatgcggcagggaaaacggaagtgttcctcgacccgaacaagttcagcgaaaaaggcacaacctcgctcgcgtccgtgtccttcaataagaagggcaccctggtggcgtatagtatctcggaaggcggttcggactggaacaaaatcatcatcctcgacgcggaaacaaagaaacagctcgacgaaaccctcctggatgtgaaattctccggcatttcttggctcggtgatgagggtttcttctacagctcgtacgacaaaccgaaagagggctccgtcctttccggcatgacggacaagcataaggtatacttccacaagttgggcaccaaacagtctcaggacgagctcatcatcggcggtgacaagttccctcgccgttacatcggcgcgtacgtgacggacgaccagcgttatctcgtggtatcggctgcgaacgccaccaacggcaatgagctgtatatcaaggatctgaagaataagaccgacttcatcccgattatcacgggttttgattccaacgttaacgtggcagatacggacggtgacaccctgtatctcttcaccgacaaggatgcgccgaataaacggctggtcaagactaccatccagaatccgaaagccgagacgtggaaggatgtaatcgcggaaacctcggagccgctggagatcaatacgggtgggggctatttcttcgcgacatatatgaaggatgcgatcgaccaggtgaaacaatacgacaaaaatggtaaactcgtgcgggcgattaaactcccgggctccggtaatgcgagcgggttcggcggtgaaaagaccgagaaagacctttactatagttttaccaattacatcactccgcccaccatcttcaagtataatgtgacgacaggcaatagcgaagtgtaccagaagccgaaggtgaaattcaatcccgaaaactacgtgtccgaacaggtgttctatacctcgtcggacggcaccaagatcccgatgatgattagctataagaaaggcctgaaaaaggacgggaaaaacccgacgatcctgtatagctatggcggcttcaatatcagtctgcagccggcgttctctgtcgtgaacgcgatctggatggagaatggtggcatctatgcggtcccgaacattcgaggcggtggggagtatggcaagaagtggcatgacgctggcacgaaaatgcagaagaaaaatgtgttcaatgatttcatcgcagcgggcgagtatctccagaagaatggctatacctccaaagagtacatggccctcagcggacgcgcgaatggtggcctgctggtcggcgcaactatgaccatgcgcccagatcttgcgaaagtggcgttcccgggtgtcggcgtcctcgatatgctgcggtacaataagtttaccgcgggagcgggctgggcctacgactacggcaccgcagaagatagtaaagagatgttcgagtatctgaaaagctatagccccgtgcacaatgttaaagcgggaacgtgctacccgagcacaatggtcatcacgtcggatcacgacgatcgggtggtaccggcccatagtttcaagttcggcagcgaactccaagccaagcaatcctgcaaaaatccgatcctgatccgcatcgaaaccaatgcaggcgctggggcagggcgttcgaccgagcaagtcgtcgcggagaatgcggatctcctctcctttgcgctctacgagatgggcatcaagtcactcaaactg

SEQ ID NO: 162 - protein, 709 aa, Artificial sequence; identical to SEQ ID NO: 152
  Synthetic Construct

SEQ ID NO: 163 - DNA, 2127 bp, Artificial sequence
  Synthetic construct
  CDS (1)..(2127): S9A family peptidase (codon optimized nucleic acid)
atgtggtcccacccccagttcgagaaggccagcccgtatccgtatgatgtccccgactatgcgggctcgcaaaatagcaattcgctgaagtaccccgagacgaagaaagtgagtcacacggacacctacttcggcacccaggtcagcgacccgtatcgctggctcgaagatgatcgggccgaggataccaaggcgtgggtgcagcaagaggtcaagttcacccaggattatcttgctcaaattccgttccgcgaccagctgaaaaagcaactcatggatatctggaactacgaaaagatttcggcaccgttcaagaagggtaagtatacctacttcagcaaaaacgacgggctgcaagcgcagagcgtgctgtatcgcaaagacgcagcgggaaagactgaggtgttcctggacccgaacaagtttagcgagaaggggaccacctccctcgccagcgtctccttcaataagaagggcaccctggtcgcgtacagtatctccgagggcggctcggactggaataagatcatcatccttgacgcggaaacgaagaagcagctggacgagacattgctcgatgtcaagttcagtggaatttcgtggctcggcgatgaaggcttcttctactcctcctacgacaaacccaaagaagggtcggtcctgtcgggcatgactgataaacacaaggtgtacttccacaagctgggcaccaagcaatcgcaggatgaactgatcatcggcggtgacaagttcccccggagatacatcggtgcctacgtgaccgatgaccagcgctacctcgtcgtctcagcggcgaatgcgaccaatggcaatgaactgtatatcaaagatctgaagaataagaccgacttcatccccatcatcacaggcttcgattcgaacgtgaatgtcgcggataccgacggcgacaccctgtatttgttcacggataaggatgccccgaataagcgcctcgtgaaaacgacaattcagaatccgaaggcggaaacctggaaggacgtgatcgcggagacttccgagccgcttgagatcaatacgggtggcggctatttcttcgcgacctacatgaaggacgccatcgaccaagtgaagcagtacgacaagaatggcaagctcgtgcgggcgatcaagctcccgggctctggcaatgcgtcgggcttcgggggtgaaaagacggagaaggacctgtattactccttcaccaattacattacgccgcctaccatctttaagtacaatgtcacgacgggaaacagcgaagtctaccaaaagcccaaggtgaagttcaatccggagaattacgtgtcggaacaggtgttctacacaagcagcgacggcaccaagatcccgatgatgatctcgtataagaaaggcctcaagaaggatgggaagaatccgacgatcctgtactcgtacggcggtttcaacatctcgctccagcccgcgttctccgtggtaaatgcgatctggatggagaatggtggcatttatgcggtcccgaatatccgcggtggcggagaatatggcaaaaagtggcatgatgcgggcacgaagatgcagaagaaaaatgtctttaatgacttcatcgcagcgggcgagtacttgcagaagaatggctacacctcgaaagagtacatggcgctctcgggccgagcgaatgggggcctgctggtaggggcgaccatgacgatgcggccagacttggcgaaggtcgcgtttccgggcgtgggcgtgctggacatgcttcggtataacaagttcaccgcaggcgctggatgggcgtacgactacggcaccgcggaagattcgaaagagatgttcgagtatctcaagtcgtactcccccgtgcataatgtgaaggcgggcacctgttacccgtcgacgatggtcatcacctcggaccatgacgaccgcgtcgttccggcccattcctttaagttcggcagcgagctgcaggcgaagcagtcgtgcaagaacccgatcctcatccgcatcgagacgaatgcaggcgctggtgcgggtcgctctacagaacaagtagtggcggaaaacgccgatctcctgtcgttcgcgttgtatgagatgggcatcaagagcctcaagctg

SEQ ID NO: 164 - protein, 709 aa, Artificial sequence; identical to SEQ ID NO: 152
  Synthetic Construct

SEQ ID NO: 165 - DNA, 2127 bp, Artificial sequence
  Synthetic construct
  CDS (1)..(2127): S9A family peptidase (codon optimized nucleic acid)
atgtggtcgcacccccaatttgagaaagcgagcccctacccgtacgacgtgcccgattacgcggggtcgcagaactcgaacagcctcaaataccccgagacaaagaaagtctcgcatacagatacctatttcggcacccaagtgtcggacccgtaccgctggcttgaggatgaccgggcagaggacacgaaggcgtgggtccagcaagaggtgaaattcacgcaggattacctggcccaaatcccgttcagggaccagctcaaaaagcagctcatggatatctggaactacgagaaaatcagtgccccgttcaagaagggcaagtatacctacttctccaaaaatgacggcctgcaggcgcagtcggtcctgtatcgcaaggatgcagccggtaagaccgaggtctttctcgaccccaacaagttcagcgagaaaggcaccacctcgctcgcgtcggttagctttaacaaaaagggcaccttggtcgcgtactcgatctccgagggcggcagcgactggaacaaaatcatcatcttggatgcggagacgaagaaacagcttgacgaaaccctgctcgatgtgaaattctcgggcatttcgtggctcggcgacgagggcttcttctactcctcatacgacaagcccaaagagggcagcgtgctgtccggcatgacagataaacataaagtatacttccataaactgggcaccaaacagtcgcaggacgagctcatcatcggcggtgacaaattccccaggcggtatatcggtgcgtatgtcaccgacgaccagaggtacctggtggtatctgcggccaatgccaccaacggcaacgagctctacatcaaggacctgaagaacaaaaccgatttcatccccatcatcaccggcttcgattccaatgtgaatgtggcggacaccgatggggacaccctttatctcttcaccgataaggacgcgcccaacaaacgcctggtaaagaccaccatccagaacccaaaagccgagacgtggaaggatgtgatcgcggagacgagcgagccgctggagatcaacacgggcggtggctacttcttcgccacctatatgaaagacgcgattgaccaggtgaagcagtacgacaagaatggcaagctcgtgcgggccatcaaactgccggggtcgggcaatgcgagtggcttcggtggcgaaaagaccgagaaggatctgtactattccttcaccaactatatcacaccgccgaccatcttcaagtacaatgttaccaccggcaactccgaggtgtaccagaagccgaaggtcaaattcaaccccgagaactacgtcagcgaacaggtgttctacacctcctcggacggcacgaagatcccgatgatgatctcctacaaaaagggcctgaagaaagacggcaaaaacccgacgatcttgtacagttatggcggcttcaacatctcgctccagccggcgttcagcgtggtcaacgccatctggatggagaatgggggcatctacgcggtgccgaacatccgcggtgggggcgagtatggcaagaaatggcatgatgccggcaccaaaatgcagaaaaagaatgtctttaacgacttcatcgctgcgggcgagtatctgcagaagaacggctatacctcgaaagagtacatggcgctcagcggtcgcgccaatggcggtctgctcgtcggtgcgacgatgaccatgaggccggacctcgcgaaggtagccttcccgggtgtgggcgtgctcgacatgctccgctataacaagttcactgccggagcgggttgggcgtatgattatggcaccgcggaagatagcaaagagatgttcgagtacctgaaatcgtacagcccggtccataatgtgaaggccggtacttgctatccttccacgatggtgattacatcggaccatgatgaccgcgtcgtacccgcgcactcgttcaaattcgggtcggagctgcaggccaaacagtcgtgcaagaacccgattctcatccgcattgagacaaatgcaggcgctggagccggtcggtccaccgagcaagtggtcgccgagaacgccgacttgctgagcttcgccctctacgagatgggcatcaagtcgctgaagctg

SEQ ID NO: 166 - protein, 709 aa, Artificial sequence; identical to SEQ ID NO: 152
  Synthetic Construct

What is claimed is:

1. A recombinant $C_1$ metabolizing microorganism, comprising:
(a) a first heterologous nucleic acid selected from
(i) a heterologous nucleic acid that encodes an L-amino acid biosynthesis enzyme for producing a desired amino acid selected from L-lysine, L-tryptophan, L-methionine, L-cysteine, L-threonine, L-histidine, and L-valine, and
(ii) a heterologous nucleic acid comprising an expression control sequence that is operably linked to a nucleic acid that encodes a native L-amino acid biosynthesis enzyme for producing the desired amino acid, and
(b) a second heterologous nucleic acid that encodes a cache polypeptide that comprises at least 70 amino acid residues in length and comprises the desired amino acid at a level that is 10% or more of the total number of amino acid residues in the cache polypeptide;
wherein the recombinant $C_1$ metabolizing microorganism is capable of converting a natural gas-derived carbon feedstock into the desired L-amino acid at an increased level as compared to the non-genetically engineered $C_1$ metabolizing microorganism,
wherein a $\delta^{13}C$ value of the recombinant $C_1$ metabolizing microorganism is less than −30‰, and
wherein
when the desired amino acid is L-lysine, the L-amino acid biosynthesis enzyme of (a) (i) or the native L-amino acid biosynthesis enzyme of (a) (ii) is a lysine biosynthesis enzyme, and the cache polypeptide of (b) comprises lysine at a level that is 10% or more of the total number of amino acid residues in the cache polypeptide of (b),
when the desired amino acid is L-tryptophan, the L-amino acid biosynthesis enzyme of (a) (i) or the native L-amino acid biosynthesis enzyme of (a) (ii) is a tryptophan biosynthesis enzyme, and the cache polypeptide of (b) comprises tryptophan at a level that is 10% or more of the total number of amino acid residues in the cache polypeptide of (b),
when the desired amino acid is L-methionine, the L-amino acid biosynthesis enzyme of (i) or the native L-amino acid biosynthesis enzyme of (ii) is a methionine biosynthesis enzyme, and the cache polypeptide of (b) comprises methionine at a level that is 10% or more of the total number of amino acid residues in the cache polypeptide of (b),
when the desired amino acid is L-cysteine, the L-amino acid biosynthesis enzyme of (i) or the native L-amino acid biosynthesis enzyme of (ii) is a cysteine biosynthesis enzyme, and the cache polypeptide of (b) comprises cysteine at a level that is 10% or more of the total number of amino acid residues in the cache polypeptide of (b),
when the desired amino acid is L-threonine, the L-amino acid biosynthesis enzyme of (i) or the native L-amino acid biosynthesis enzyme of (ii) is a threonine biosynthesis enzyme, and the cache polypeptide of (b) comprises threonine at a level that is 10% or more of the total number of amino acid residues in the cache polypeptide of (b),
when the desired amino acid is L-histidine, the L-amino acid biosynthesis enzyme of (i) or the native L-amino acid biosynthesis enzyme of (ii) is a histidine biosynthesis enzyme, and the cache polypeptide of (b) comprises histidine at a level that is 10% or more of the total number of amino acid residues in the cache polypeptide of (b), and
when the desired amino acid is L-valine, the L-amino acid biosynthesis enzyme of (i) or the native L-amino acid biosynthesis enzyme of (ii) is a valine biosynthesis enzyme, and the cache polypeptide of (b) comprises valine at a level that is 10% or more of the total number of amino acid residues in the cache polypeptide of (b).

2. The recombinant $C_1$ metabolizing microorganism of claim 1, wherein the first heterologous nucleic acid is the heterologous nucleic acid that encodes an L-amino acid biosynthesis enzyme for producing a desired amino acid selected from the group consisting of L-lysine, L-tryptophan, L-methionine, L-cysteine, L-threonine, L-histidine, and L-valine.

3. The recombinant $C_1$ metabolizing microorganism of claim 1, wherein the natural gas-derived carbon feedstock is natural gas.

4. The recombinant $C_1$ metabolizing microorganism of claim 1, wherein the natural gas-derived carbon feedstock is methane.

5. The recombinant $C_1$ metabolizing microorganism of claim 1, wherein the recombinant $C_1$ metabolizing microorganism comprises the ability to produce the desired L-amino acid at a level that is at least about 10% greater than that produced by the non-genetically engineered $C_1$ metabolizing microorganism.

6. The recombinant $C_1$ metabolizing microorganism of claim 1, wherein the $C_1$ metabolizing microorganism is a methanotroph.

7. The recombinant $C_1$ metabolizing microorganism of claim 6, wherein the methanotroph is a facultative methanotroph selected from *Methylocella silvestris, Methylocella palustris, Methylocella tundrae, Methylocystis daltona* strain SB2, *Methylocystis bryophila*, and *Methylocapsa aurea* KYG, or *Methylobacterium organophilum*.

8. The recombinant $C_1$ metabolizing microorganism of claim 6, wherein the methanotroph is an obligate methanotroph selected from *Methylococcus capsulatus* Bath, *Methylosinus trichosporium* OB3b, *Methylomonas* sp. 16a, *Methylosinus sporium*, *Methylocystis parvus*, *Methylomonas methanica*, *Methylomonas albus*, *Methylobacter capsulatus* Y, *Methylomonas flagellata* sp. AJ-3670, *Methylacidiphilum infernorum*, *Methylacidiphilum fumariolicum*, *Methylomicrobium alcaliphilum*, or *Methyloacida kamchatkensis*.

9. The recombinant $C_1$ metabolizing microorganism of claim 1, wherein the desired L-amino acid is L-methionine, and wherein the first heterologous nucleic acid encodes a methionine biosynthesis enzyme selected from the group consisting of a homoserine O-succinyltransferase (metA), a cystathionine gamma-synthase (metB), a protein MalY, a cystathionine beta-lyase (metC), a B12-dependent methionine synthase (metH), and a 5-methyltetrahydropteroyltriglutamate-homocysteine S-methyltransferase (metE).

10. The recombinant $C_1$ metabolizing microorganism of claim 1, wherein the L-amino acid is L-cysteine, and wherein the first heterologous nucleic acid encodes a cysteine biosynthesis enzyme selected from the group consisting of a serine acetyltransferase (CysE), a cysteine synthase A, and a cysteine synthase B.

11. The recombinant $C_1$ metabolizing microorganism of claim 1, wherein the desired L-amino acid is L-threonine, and wherein the first heterologous nucleic acid encodes a threonine biosynthesis enzyme selected from the group consisting of an aspartate transaminase, a PLP-dependent aminotransferase, an aspartate aminotransferase, an aspartate kinase, an aspartate-semialdehyde dehydrogenase, a homoserine dehydrogenase, a homoserine kinase, and a threonine synthase.

12. The recombinant $C_1$ metabolizing microorganism of claim 1, wherein the desired L-amino acid is L-tryptophan, and wherein the first heterologous nucleic acid encodes a tryptophan biosynthesis enzyme selected from the group consisting of a chorismate-pyruvate lyase (ubiC), an anthranilate synthase component I (trpE), an anthranilate synthase component II (trpG), an anthranilate phosphoribosyltransferase (trpD), a phosphoribosylanthranilate isomerase (trpC), a tryptophan biosynthesis protein (trpC), an N-(5'-phosphoribosyl)anthranilate isomerase (trpF), an indole-3-glycerol phosphate synthase, a tryptophan synthase alpha chain (trpA), and a tryptophan synthase beta chain (trpB).

13. The recombinant $C_1$ metabolizing microorganism of claim 1, wherein the first heterologous nucleic acid encodes an L-amino acid biosynthesis enzyme having an amino acid sequence that has at least 90% sequence identity to the parental wildtype amino acid sequence selected from the group consisting of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, and 150.

14. The recombinant $C_1$ metabolizing microorganism of claim 1, wherein the first heterologous nucleic acid encodes an expression control sequence that is operably linked to a nucleic acid encoding a native L-amino acid biosynthesis enzyme.

15. The recombinant $C_1$ metabolizing microorganism of claim 1, wherein the sequence of the first heterologous nucleic acid is codon optimized for the recombinant $C_1$ metabolizing microorganism.

16. The recombinant $C_1$ metabolizing microorganism of claim 1, wherein the sequence of the second heterologous nucleic acid is codon optimized for the recombinant $C_1$ metabolizing microorganism.

17. The recombinant $C_1$ metabolizing microorganism of claim 1, wherein the first heterologous nucleic acid encodes an L-amino acid biosynthesis enzyme and has a nucleic acid sequence that is at least 85% sequence identity to the parental wildtype nucleotide sequence selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, and 149.

18. The recombinant $C_1$ metabolizing microorganism of claim 1, wherein the microorganism exhibits a $\delta^{13}C$ value that is less than −35‰.

19. The recombinant $C_1$ metabolizing microorganism of claim 1, wherein the desired L-amino acid is L-lysine, and wherein the first heterologous nucleic acid encodes a lysine biosynthesis enzyme selected from the group consisting of a lysine-sensitive aspartokinase III (lysC), an aspartate kinase, an aspartate-semialdehyde dehydrogenase (asd), a dihydrodipicolinate synthase (dapA), a dihydrodipicolinate reductase (dapB), a 2,3,4,5-tetrahydropyridine-2,6-carboxylate N-succinyltransferase (dapD), an acetylornithine/succinyldiaminopimelate aminotransferase (argD), a succinyl-diaminopimelate desuccinylase (dapE), a succinyldiaminopimelate transaminase, a diaminopimelate epimerase (dapF), and a diaminopimetatae dicarboxylase (lysA).

20. A biomass of the recombinant $C_1$ metabolizing microorganism of claim 1.

21. The biomass of claim 20, wherein the $\delta^{13}C$ value of the biomass is less than −35‰.

* * * * *

UNITED STATES PATENT AND TRADEMARK OFFICE
CERTIFICATE OF CORRECTION

PATENT NO. : 10,889,842 B2
APPLICATION NO. : 14/599383
DATED : January 12, 2021
INVENTOR(S) : Renee M. Saville et al.

It is certified that error appears in the above-identified patent and that said Letters Patent is hereby corrected as shown below:

On the Title Page

Page 2, Column 1, Item (56), References Cited, Other Publications, Line 14:
"Föner et al., "Expression of polyhydroxyalkanoic-acid-biosynthesis genes in methylotrophic bacteria relying on the ribose monophosphate pathway," *Appl Microbiol Biothechnol 40*:284-291, 1993." should read: --Föllner et al., "Expression of polyhydroxyalkanoic-acid-biosynthesis genes in methylotrophic bacteria relying on the ribose monophosphate pathway," *Appl Microbiol Biothechnol 40*:284-291, 1993.--.

Signed and Sealed this
Fourteenth Day of September, 2021

Drew Hirshfeld
*Performing the Functions and Duties of the
Under Secretary of Commerce for Intellectual Property and
Director of the United States Patent and Trademark Office*